United States Patent 12,097,253 (RSV RNA MOLECULES AND COMPOSITIONS FOR VACCINATION) - sequence listing, part 3

SEQ ID NO: 2452 - RNA, 1948 nt, synthetic construct
  misc_feature 1..1948: note = mRNA product Design b-4 comprising derived and/or modified sequence from HRSV(A2)__F_DSCav1_mut2 (opt5)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2453 - RNA, 1948 nt, synthetic construct
  misc_feature 1..1948: note = mRNA product Design b-4 comprising derived and/or modified sequence from HRSV(A2)__F_DSCav1_mut2 (opt6)
  source 1..1948: mol_type = other RNA
gggagagtcccgcagtcggcgtccagcggctctgcttgttcgtgtgtgtgtcgttgcaggccttattcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2454 - RNA, 1948 nt, synthetic construct
  misc_feature 1..1948: note = mRNA product Design b-4 comprising derived and/or modified sequence from HRSV(A2)__F_DSCav1_mut2 (opt11)
  source 1..1948: mol_type = other RNA
gggagagtcccgcagtcggcgtccagcggctctgcttgttcgtgtgtgtgtcgttgcaggccttattcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2455 - RNA, 2010 nt, synthetic construct
  misc_feature 1..2010: note = mRNA product Design b-5 comprising derived and/or modified sequence from HRSV(A2)__F_DSCav1_mut2 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2456 - RNA, 2010 nt, synthetic construct
  misc_feature 1..2010: note = mRNA product Design b-5 comprising derived and/or modified sequence from HRSV(A2)__F_DSCav1_mut2 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2457 - RNA, 2010 nt, synthetic construct
  misc_feature 1..2010: note = mRNA product Design b-5 comprising derived and/or modified sequence from HRSV(A2)__F_DSCav1_mut2 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2458 - RNA, 2010 nt, synthetic construct
  misc_feature 1..2010: note = mRNA product Design b-5 comprising derived and/or modified sequence from HRSV(A2)__F_DSCav1_mut2 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2459 - RNA, 2010 nt, synthetic construct
  misc_feature 1..2010: note = mRNA product Design b-5 comprising derived and/or modified sequence from HRSV(A2)__F_DSCav1_mut2 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2460 - RNA, 2010 nt, synthetic construct
  misc_feature 1..2010: note = mRNA product Design b-5 comprising derived and/or modified sequence from HRSV(A2)__F_DSCav1_mut2 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2461 - RNA, 2010 nt, synthetic construct
  misc_feature 1..2010: note = mRNA product Design b-5 comprising derived and/or modified sequence from HRSV(A2)__F_DSCav1_mut2 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2462 - RNA, 2010 nt, synthetic construct
  misc_feature 1..2010: note = mRNA product Design b-5 comprising derived and/or modified sequence from HRSV(A2)__F_DSCav1_mut2 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2463 - RNA, 1916 nt, synthetic construct
  misc_feature 1..1916: note = mRNA product Design c-1 comprising derived and/or modified sequence from HRSV(A2)__F_DSCav1_mut2 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2464 - RNA, 1916 nt, synthetic construct
  misc_feature 1..1916: note = mRNA product Design c-1 comprising derived and/or modified sequence from HRSV(A2)__F_DSCav1_mut2 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2465 - RNA, 1916 nt, synthetic construct
  misc_feature 1..1916: note = mRNA product Design c-1 comprising derived and/or modified sequence from HRSV(A2)__F_DSCav1_mut2 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2466 - RNA, 1916 nt, synthetic construct
  misc_feature 1..1916: note = mRNA product Design c-1 comprising derived and/or modified sequence from HRSV(A2)__F_DSCav1_mut2 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2467 - RNA, 1916 nt, synthetic construct
  misc_feature 1..1916: note = mRNA product Design c-1 comprising derived and/or modified sequence from HRSV(A2)__F_DSCav1_mut2 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2468 - RNA, 1916 nt, synthetic construct
  misc_feature 1..1916: note = mRNA product Design c-1 comprising derived and/or modified sequence from HRSV(A2)__F_DSCav1_mut2 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2469 - RNA, 1916 nt, synthetic construct
  misc_feature 1..1916: note = mRNA product Design c-1 comprising derived and/or modified sequence from HRSV(A2)__F_DSCav1_mut2 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2470 - RNA, 1916 nt, synthetic construct
  misc_feature 1..1916: note = mRNA product Design c-1 comprising derived and/or modified sequence from HRSV(A2)__F_DSCav1_mut2 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2471 - RNA, 2006 nt, synthetic construct
  misc_feature 1..2006: note = mRNA product Design c-2 comprising derived and/or modified sequence from HRSV(A2)__F_DSCav1_mut2 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2472 - RNA, 2006 nt, synthetic construct
  misc_feature 1..2006: note = mRNA product Design c-2 comprising derived and/or modified sequence from HRSV(A2)__F_DSCav1_mut2 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2473 - RNA, 2006 nt, synthetic construct
  misc_feature 1..2006: note = mRNA product Design c-2 comprising derived and/or modified sequence from HRSV(A2)__F_DSCav1_mut2 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2474 - RNA, 2006 nt, synthetic construct
  misc_feature 1..2006: note = mRNA product Design c-2 comprising derived and/or modified sequence from HRSV(A2)__F_DSCav1_mut2 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2475 - RNA, 2006 nt, synthetic construct
  misc_feature 1..2006: note = mRNA product Design c-2 comprising derived and/or modified sequence from HRSV(A2)__F_DSCav1_mut2 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2476 - RNA, 2006 nt, synthetic construct
  misc_feature 1..2006: note = mRNA product Design c-2 comprising derived and/or modified sequence from HRSV(A2)__F_DSCav1_mut2 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2477 - RNA, 2006 nt, synthetic construct
  misc_feature 1..2006: note = mRNA product Design c-2 comprising derived and/or modified sequence from HRSV(A2)__F_DSCav1_mut2 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2478 - RNA, 2006 nt, synthetic construct
  misc_feature 1..2006: note = mRNA product Design c-2 comprising derived and/or modified sequence from HRSV(A2)__F_DSCav1_mut2 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2479 - RNA, 1983 nt, synthetic construct
  misc_feature 1..1983: note = mRNA product Design c-3 comprising derived and/or modified sequence from HRSV(A2)__F_DSCav1_mut2 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2480 - RNA, 1983 nt, synthetic construct
  misc_feature 1..1983: note = mRNA product Design c-3 comprising derived and/or modified sequence from HRSV(A2)__F_DSCav1_mut2 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2481 - RNA, 1983 nt, synthetic construct
  misc_feature 1..1983: note = mRNA product Design c-3 comprising derived and/or modified sequence from HRSV(A2)__F_DSCav1_mut2 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2482 - RNA, 1983 nt, synthetic construct
  misc_feature 1..1983: note = mRNA product Design c-3 comprising derived and/or modified sequence from HRSV(A2)__F_DSCav1_mut2 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2483 - RNA, 1983 nt, synthetic construct
  misc_feature 1..1983: note = mRNA product Design c-3 comprising derived and/or modified sequence from HRSV(A2)__F_DSCav1_mut2 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2484 - RNA, 1983 nt, synthetic construct
  misc_feature 1..1983: note = mRNA product Design c-3 comprising derived and/or modified sequence from HRSV(A2)__F_DSCav1_mut2 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2485 - RNA, 1983 nt, synthetic construct
  misc_feature 1..1983: note = mRNA product Design c-3 comprising derived and/or modified sequence from HRSV(A2)__F_DSCav1_mut2 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2486 - RNA, 1983 nt, synthetic construct
  misc_feature 1..1983: note = mRNA product Design c-3 comprising derived and/or modified sequence from HRSV(A2)__F_DSCav1_mut2 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2487 - RNA, 1979 nt, synthetic construct
  misc_feature 1..1979: note = mRNA product Design c-4 comprising derived and/or modified sequence from HRSV(A2)__F_DSCav1_mut2 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2488 - RNA, 1979 nt, synthetic construct
  misc_feature 1..1979: note = mRNA product Design c-4 comprising derived and/or modified sequence from HRSV(A2)__F_DSCav1_mut2 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2489 - RNA, 1979 nt, synthetic construct
  misc_feature 1..1979: note = mRNA product Design c-4 comprising derived and/or modified sequence from HRSV(A2)__F_DSCav1_mut2 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2490 - RNA, 1979 nt, synthetic construct
  misc_feature 1..1979: note = mRNA product Design c-4 comprising derived and/or modified sequence from HRSV(A2)__F_DSCav1_mut2 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2491 - RNA, 1979 nt, synthetic construct
  misc_feature 1..1979: note = mRNA product Design c-4 comprising derived and/or modified sequence from HRSV(A2)__F_DSCav1_mut2 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2492 - RNA, 1979 nt, synthetic construct
  misc_feature 1..1979: note = mRNA product Design c-4 comprising derived and/or modified sequence from HRSV(A2)__F_DSCav1_mut2 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2493 - RNA, 1979 nt, synthetic construct
  misc_feature 1..1979: note = mRNA product Design c-4 comprising derived and/or modified sequence from HRSV(A2)__F_DSCav1_mut2 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2494 - RNA, 1979 nt, synthetic construct
  misc_feature 1..1979: note = mRNA product Design c-4 comprising derived and/or modified sequence from HRSV(A2)__F_DSCav1_mut2 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2495 - RNA, 1897 nt, synthetic construct
  misc_feature 1..1897: note = mRNA product Design c-5 comprising derived and/or modified sequence from HRSV(A2)__F_DSCav1_mut2 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2496 - RNA, 1897 nt, synthetic construct
  misc_feature 1..1897: note = mRNA product Design c-5 comprising derived and/or modified sequence from HRSV(A2)__F_DSCav1_mut2 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2497 - RNA, 1897 nt, synthetic construct
  misc_feature 1..1897: note = mRNA product Design c-5 comprising derived and/or modified sequence from HRSV(A2)__F_DSCav1_mut2 (opt2)
  source 1..1897: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2498 - RNA, 1897 nt, synthetic construct
  misc_feature 1..1897: note = mRNA product Design c-5 comprising derived and/or modified sequence from HRSV(A2)__F_DSCav1_mut2 (opt3)
  source 1..1897: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2499 - RNA, 1897 nt, synthetic construct
  misc_feature 1..1897: note = mRNA product Design c-5 comprising derived and/or modified sequence from HRSV(A2)__F_DSCav1_mut2 (opt4)
  source 1..1897: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2500 - RNA, 1897 nt, synthetic construct
  misc_feature 1..1897: note = mRNA product Design c-5 comprising derived and/or modified sequence from HRSV(A2)__F_DSCav1_mut2 (opt5)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2501 - RNA, 1897 nt, synthetic construct
  misc_feature 1..1897: note = mRNA product Design c-5 comprising derived and/or modified sequence from HRSV(A2)__F_DSCav1_mut2 (opt6)
  source 1..1897: mol_type = other RNA
gggagagcggctcggccattttgtcccagtcagtccggaggctgcggctgcagaagtaccgcctgcggagtaactgcaaagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2502 - RNA, 1897 nt, synthetic construct
  misc_feature 1..1897: note = mRNA product Design c-5 comprising derived and/or modified sequence from HRSV(A2)__F_DSCav1_mut2 (opt11)
  source 1..1897: mol_type = other RNA
gggagagcggctcggccattttgtcccagtcagtccggaggctgcggctgcagaagtaccgcctgcggagtaactgcaaagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2503 - RNA, 1906 nt, synthetic construct
  misc_feature 1..1906: note = mRNA product Design d-1 comprising derived and/or modified sequence from HRSV(A2)__F_DSCav1_mut2 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2504 - RNA, 1906 nt, synthetic construct
  misc_feature 1..1906: note = mRNA product Design d-1 comprising derived and/or modified sequence from HRSV(A2)__F_DSCav1_mut2 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2505 - RNA, 1906 nt, synthetic construct
  misc_feature 1..1906: note = mRNA product Design d-1 comprising derived and/or modified sequence from HRSV(A2)__F_DSCav1_mut2 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2506 - RNA, 1906 nt, synthetic construct
  misc_feature 1..1906: note = mRNA product Design d-1 comprising derived and/or modified sequence from HRSV(A2)__F_DSCav1_mut2 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2507 - RNA, 1906 nt, synthetic construct
  misc_feature 1..1906: note = mRNA product Design d-1 comprising derived and/or modified sequence from HRSV(A2)__F_DSCav1_mut2 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2508 - RNA, 1906 nt, synthetic construct
  misc_feature 1..1906: note = mRNA product Design d-1 comprising derived and/or modified sequence from HRSV(A2)__F_DSCav1_mut2 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2509 - RNA, 1906 nt, synthetic construct
  misc_feature 1..1906: note = mRNA product Design d-1 comprising derived and/or modified sequence from HRSV(A2)__F_DSCav1_mut2 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2510 - RNA, 1906 nt, synthetic construct
  misc_feature 1..1906: note = mRNA product Design d-1 comprising derived and/or modified sequence from HRSV(A2)__F_DSCav1_mut2 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2511 - RNA, 1961 nt, synthetic construct
  misc_feature 1..1961: note = mRNA product Design d-2 comprising derived and/or modified sequence from HRSV(A2)__F_DSCav1_mut2 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2512 - RNA, 1961 nt, synthetic construct
  misc_feature 1..1961: note = mRNA product Design d-2 comprising derived and/or modified sequence from HRSV(A2)__F_DSCav1_mut2 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2513 - RNA, 1961 nt, synthetic construct
  misc_feature 1..1961: note = mRNA product Design d-2 comprising derived and/or modified sequence from HRSV(A2)__F_DSCav1_mut2 (opt2)
  source 1..1961: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2514 - RNA, 1961 nt, synthetic construct
  misc_feature 1..1961: note = mRNA product Design d-2 comprising derived and/or modified sequence from HRSV(A2)__F_DSCav1_mut2 (opt3)
  source 1..1961: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2515 - RNA, 1961 nt, synthetic construct
  misc_feature 1..1961: note = mRNA product Design d-2 comprising derived and/or modified sequence from HRSV(A2)__F_DSCav1_mut2 (opt4)
  source 1..1961: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2516 - RNA, 1961 nt, synthetic construct
  misc_feature 1..1961: note = mRNA product Design d-2 comprising derived and/or modified sequence from HRSV(A2)__F_DSCav1_mut2 (opt5)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2517 - RNA, 1961 nt, synthetic construct
  misc_feature 1..1961: note = mRNA product Design d-2 comprising derived and/or modified sequence from HRSV(A2)__F_DSCav1_mut2 (opt6)
  source 1..1961: mol_type = other RNA
gggagagcggctcggccattttgtcccagtcagtccggaggctgcggctgcagaagtaccgcctgcggagtaactgcaaagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2518 - RNA, 1961 nt, synthetic construct
  misc_feature 1..1961: note = mRNA product Design d-2 comprising derived and/or modified sequence from HRSV(A2)__F_DSCav1_mut2 (opt11)
  source 1..1961: mol_type = other RNA
gggagagcggctcggccattttgtcccagtcagtccggaggctgcggctgcagaagtaccgcctgcggagtaactgcaaagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2519 - RNA, 2277 nt, synthetic construct
  misc_feature 1..2277: note = mRNA product Design d-3 comprising derived and/or modified sequence from HRSV(A2)__F_DSCav1_mut2 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2520 - RNA, 2277 nt, synthetic construct
  misc_feature 1..2277: note = mRNA product Design d-3 comprising derived and/or modified sequence from HRSV(A2)__F_DSCav1_mut2 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2521 - RNA, 2277 nt, synthetic construct
  misc_feature 1..2277: note = mRNA product Design d-3 comprising derived and/or modified sequence from HRSV(A2)__F_DSCav1_mut2 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2522 - RNA, 2277 nt, synthetic construct
  misc_feature 1..2277: note = mRNA product Design d-3 comprising derived and/or modified sequence from HRSV(A2)__F_DSCav1_mut2 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2523 - RNA, 2277 nt, synthetic construct
  misc_feature 1..2277: note = mRNA product Design d-3 comprising derived and/or modified sequence from HRSV(A2)__F_DSCav1_mut2 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2524 - RNA, 2277 nt, synthetic construct
  misc_feature 1..2277: note = mRNA product Design d-3 comprising derived and/or modified sequence from HRSV(A2)__F_DSCav1_mut2 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2525 - RNA, 2277 nt, synthetic construct
  misc_feature 1..2277: note = mRNA product Design d-3 comprising derived and/or modified sequence from HRSV(A2)__F_DSCav1_mut2 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2526 - RNA, 2277 nt, synthetic construct
  misc_feature 1..2277: note = mRNA product Design d-3 comprising derived and/or modified sequence from HRSV(A2)__F_DSCav1_mut2 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2527 - RNA, 1960 nt, synthetic construct
  misc_feature 1..1960: note = mRNA product Design d-4 comprising derived and/or modified sequence from HRSV(A2)__F_DSCav1_mut2 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2528 - RNA, 1960 nt, synthetic construct
  misc_feature 1..1960: note = mRNA product Design d-4 comprising derived and/or modified sequence from HRSV(A2)__F_DSCav1_mut2 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2529 - RNA, 1960 nt, synthetic construct
  misc_feature 1..1960: note = mRNA product Design d-4 comprising derived and/or modified sequence from HRSV(A2)__F_DSCav1_mut2 (opt2)
  source 1..1960: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2530 - RNA, 1960 nt, synthetic construct
  misc_feature 1..1960: note = mRNA product Design d-4 comprising derived and/or modified sequence from HRSV(A2)__F_DSCav1_mut2 (opt3)
  source 1..1960: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2531 - RNA, 1960 nt, synthetic construct
  misc_feature 1..1960: note = mRNA product Design d-4 comprising derived and/or modified sequence from HRSV(A2)__F_DSCav1_mut2 (opt4)
  source 1..1960: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2532 - RNA, 1960 nt, synthetic construct
  misc_feature 1..1960: note = mRNA product Design d-4 comprising derived and/or modified sequence from HRSV(A2)__F_DSCav1_mut2 (opt5)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2533 - RNA, 1960 nt, synthetic construct
  misc_feature 1..1960: note = mRNA product Design d-4 comprising derived and/or modified sequence from HRSV(A2)__F_DSCav1_mut2 (opt6)
  source 1..1960: mol_type = other RNA
gggagagtcccgcagtcggcgtccagcggctctgcttgttcgtgtgtgtgtcgttgcaggccttattcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2534 - RNA, 1960 nt, synthetic construct
  misc_feature 1..1960: note = mRNA product Design d-4 comprising derived and/or modified sequence from HRSV(A2)__F_DSCav1_mut2 (opt11)
  source 1..1960: mol_type = other RNA
gggagagtcccgcagtcggcgtccagcggctctgcttgttcgtgtgtgtgtcgttgcaggccttattcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2535 - RNA, 2057 nt, synthetic construct
  misc_feature 1..2057: note = mRNA product Design d-5 comprising derived and/or modified sequence from HRSV(A2)__F_DSCav1_mut2 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2536 - RNA, 2057 nt, synthetic construct
  misc_feature 1..2057: note = mRNA product Design d-5 comprising derived and/or modified sequence from HRSV(A2)__F_DSCav1_mut2 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2537 - RNA, 2057 nt, synthetic construct
  misc_feature 1..2057: note = mRNA product Design d-5 comprising derived and/or modified sequence from HRSV(A2)__F_DSCav1_mut2 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2538 - RNA, 2057 nt, synthetic construct
  misc_feature 1..2057: note = mRNA product Design d-5 comprising derived and/or modified sequence from HRSV(A2)__F_DSCav1_mut2 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2539 - RNA, 2057 nt, synthetic construct
  misc_feature 1..2057: note = mRNA product Design d-5 comprising derived and/or modified sequence from HRSV(A2)__F_DSCav1_mut2 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2540 - RNA, 2057 nt, synthetic construct
  misc_feature 1..2057: note = mRNA product Design d-5 comprising derived and/or modified sequence from HRSV(A2)__F_DSCav1_mut2 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2541 - RNA, 2057 nt, synthetic construct
  misc_feature 1..2057: note = mRNA product Design d-5 comprising derived and/or modified sequence from HRSV(A2)__F_DSCav1_mut2 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2542 - RNA, 2057 nt, synthetic construct
  misc_feature 1..2057: note = mRNA product Design d-5 comprising derived and/or modified sequence from HRSV(A2)__F_DSCav1_mut2 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2543 - RNA, 1937 nt, synthetic construct
  misc_feature 1..1937: note = mRNA product Design e-1 comprising derived and/or modified sequence from HRSV(A2)__F_DSCav1_mut2 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2544 - RNA, 1937 nt, synthetic construct
  misc_feature 1..1937: note = mRNA product Design e-1 comprising derived and/or modified sequence from HRSV(A2)__F_DSCav1_mut2 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2545 - RNA, 1937 nt, synthetic construct
  misc_feature 1..1937: note = mRNA product Design e-1 comprising derived and/or modified sequence from HRSV(A2)__F_DSCav1_mut2 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2546 - RNA, 1937 nt, synthetic construct
  misc_feature 1..1937: note = mRNA product Design e-1 comprising derived and/or modified sequence from HRSV(A2)__F_DSCav1_mut2 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2547 - RNA, 1937 nt, synthetic construct
  misc_feature 1..1937: note = mRNA product Design e-1 comprising derived and/or modified sequence from HRSV(A2)__F_DSCav1_mut2 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2548 - RNA, 1937 nt, synthetic construct
  misc_feature 1..1937: note = mRNA product Design e-1 comprising derived and/or modified sequence from HRSV(A2)__F_DSCav1_mut2 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2549 - RNA, 1937 nt, synthetic construct
  misc_feature 1..1937: note = mRNA product Design e-1 comprising derived and/or modified sequence from HRSV(A2)__F_DSCav1_mut2 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2550 - RNA, 1937 nt, synthetic construct
  misc_feature 1..1937: note = mRNA product Design e-1 comprising derived and/or modified sequence from HRSV(A2)__F_DSCav1_mut2 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2551 - RNA, 1919 nt, synthetic construct
  misc_feature 1..1919: note = mRNA product Design e-2 comprising derived and/or modified sequence from HRSV(A2)__F_DSCav1_mut2 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2552 - RNA, 1919 nt, synthetic construct
  misc_feature 1..1919: note = mRNA product Design e-2 comprising derived and/or modified sequence from HRSV(A2)__F_DSCav1_mut2 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2553 - RNA, 1919 nt, synthetic construct
  misc_feature 1..1919: note = mRNA product Design e-2 comprising derived and/or modified sequence from HRSV(A2)__F_DSCav1_mut2 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2554 - RNA, 1919 nt, synthetic construct
  misc_feature 1..1919: note = mRNA product Design e-2 comprising derived and/or modified sequence from HRSV(A2)__F_DSCav1_mut2 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2555 - RNA, 1919 nt, synthetic construct
  misc_feature 1..1919: note = mRNA product Design e-2 comprising derived and/or modified sequence from HRSV(A2)__F_DSCav1_mut2 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2556 - RNA, 1919 nt, synthetic construct
  misc_feature 1..1919: note = mRNA product Design e-2 comprising derived and/or modified sequence from HRSV(A2)__F_DSCav1_mut2 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2557 - RNA, 1919 nt, synthetic construct
  misc_feature 1..1919: note = mRNA product Design e-2 comprising derived and/or modified sequence from HRSV(A2)__F_DSCav1_mut2 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2558 - RNA, 1919 nt, synthetic construct
  misc_feature 1..1919: note = mRNA product Design e-2 comprising derived and/or modified sequence from HRSV(A2)__F_DSCav1_mut2 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2559 - RNA, 1889 nt, synthetic construct
  misc_feature 1..1889: note = mRNA product Design e-3 comprising derived and/or modified sequence from HRSV(A2)__F_DSCav1_mut2 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2560 - RNA, 1889 nt, synthetic construct
  misc_feature 1..1889: note = mRNA product Design e-3 comprising derived and/or modified sequence from HRSV(A2)__F_DSCav1_mut2 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2561 - RNA, 1889 nt, synthetic construct
  misc_feature 1..1889: note = mRNA product Design e-3 comprising derived and/or modified sequence from HRSV(A2)__F_DSCav1_mut2 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2562 - RNA, 1889 nt, synthetic construct
  misc_feature 1..1889: note = mRNA product Design e-3 comprising derived and/or modified sequence from HRSV(A2)__F_DSCav1_mut2 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2563 - RNA, 1889 nt, synthetic construct
  misc_feature 1..1889: note = mRNA product Design e-3 comprising derived and/or modified sequence from HRSV(A2)__F_DSCav1_mut2 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2564 - RNA, 1889 nt, synthetic construct
  misc_feature 1..1889: note = mRNA product Design e-3 comprising derived and/or modified sequence from HRSV(A2)__F_DSCav1_mut2 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2565 - RNA, 1889 nt, synthetic construct
  misc_feature 1..1889: note = mRNA product Design e-3 comprising derived and/or modified sequence from HRSV(A2)__F_DSCav1_mut2 (opt6)
  source 1..1889: mol_type = other RNA
gggagactttcccattctgtagcagaatttggtgttgcctgtggtcttggtcccgcggagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2566 - RNA, 1889 nt, synthetic construct
  misc_feature 1..1889: note = mRNA product Design e-3 comprising derived and/or modified sequence from HRSV(A2)__F_DSCav1_mut2 (opt11)
  source 1..1889: mol_type = other RNA
gggagactttcccattctgtagcagaatttggtgttgcctgtggtcttggtcccgcggagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2567 - RNA, 1943 nt, synthetic construct
  misc_feature 1..1943: note = mRNA product Design e-4 comprising derived and/or modified sequence from HRSV(A2)__F_DSCav1_mut2 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2568 - RNA, 1943 nt, synthetic construct
  misc_feature 1..1943: note = mRNA product Design e-4 comprising derived and/or modified sequence from HRSV(A2)__F_DSCav1_mut2 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2569 - RNA, 1943 nt, synthetic construct
  misc_feature 1..1943: note = mRNA product Design e-4 comprising derived and/or modified sequence from HRSV(A2)__F_DSCav1_mut2 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2570 - RNA, 1943 nt, synthetic construct
  misc_feature 1..1943: note = mRNA product Design e-4 comprising derived and/or modified sequence from HRSV(A2)__F_DSCav1_mut2 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2571 - RNA, 1943 nt, synthetic construct
  misc_feature 1..1943: note = mRNA product Design e-4 comprising derived and/or modified sequence from HRSV(A2)__F_DSCav1_mut2 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2572 - RNA, 1943 nt, synthetic construct
  misc_feature 1..1943: note = mRNA product Design e-4 comprising derived and/or modified sequence from HRSV(A2)__F_DSCav1_mut2 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2573 - RNA, 1943 nt, synthetic construct
  misc_feature 1..1943: note = mRNA product Design e-4 comprising derived and/or modified sequence from HRSV(A2)__F_DSCav1_mut2 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2574 - RNA, 1943 nt, synthetic construct
  misc_feature 1..1943: note = mRNA product Design e-4 comprising derived and/or modified sequence from HRSV(A2)__F_DSCav1_mut2 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2575 - RNA, 1910 nt, synthetic construct
  misc_feature 1..1910: note = mRNA product Design e-5 comprising derived and/or modified sequence from HRSV(A2)__F_DSCav1_mut2 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2576 - RNA, 1910 nt, synthetic construct
  misc_feature 1..1910: note = mRNA product Design e-5 comprising derived and/or modified sequence from HRSV(A2)__F_DSCav1_mut2 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2577 - RNA, 1910 nt, synthetic construct
  misc_feature 1..1910: note = mRNA product Design e-5 comprising derived and/or modified sequence from HRSV(A2)__F_DSCav1_mut2 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2578 - RNA, 1910 nt, synthetic construct
  misc_feature 1..1910: note = mRNA product Design e-5 comprising derived and/or modified sequence from HRSV(A2)__F_DSCav1_mut2 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2579 - RNA, 1910 nt, synthetic construct
  misc_feature 1..1910: note = mRNA product Design e-5 comprising derived and/or modified sequence from HRSV(A2)__F_DSCav1_mut2 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2580 - RNA, 1910 nt, synthetic construct
  misc_feature 1..1910: note = mRNA product Design e-5 comprising derived and/or modified sequence from HRSV(A2)__F_DSCav1_mut2 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2581 - RNA, 1910 nt, synthetic construct
  misc_feature 1..1910: note = mRNA product Design e-5 comprising derived and/or modified sequence from HRSV(A2)__F_DSCav1_mut2 (opt6)
  source 1..1910: mol_type = other RNA
gggagagcggctcggccattttgtcccagtcagtccggaggctgcggctgcagaagtaccgcctgcggagtaactgcaaagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2582 - RNA, 1910 nt, synthetic construct
  misc_feature 1..1910: note = mRNA product Design e-5 comprising derived and/or modified sequence from HRSV(A2)__F_DSCav1_mut2 (opt11)
  source 1..1910: mol_type = other RNA
gggagagcggctcggccattttgtcccagtcagtccggaggctgcggctgcagaagtaccgcctgcggagtaactgcaaagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2583 - RNA, 1977 nt, synthetic construct
  misc_feature 1..1977: note = mRNA product Design e-6 comprising derived and/or modified sequence from HRSV(A2)__F_DSCav1_mut2 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2584 - RNA, 1977 nt, synthetic construct
  misc_feature 1..1977: note = mRNA product Design e-6 comprising derived and/or modified sequence from HRSV(A2)__F_DSCav1_mut2 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2585 - RNA, 1977 nt, synthetic construct
  misc_feature 1..1977: note = mRNA product Design e-6 comprising derived and/or modified sequence from HRSV(A2)__F_DSCav1_mut2 (opt2)
  source 1..1977: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2586 - RNA, 1977 nt, synthetic construct
  misc_feature 1..1977: note = mRNA product Design e-6 comprising derived and/or modified sequence from HRSV(A2)__F_DSCav1_mut2 (opt3)
  source 1..1977: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2587 - RNA, 1977 nt, synthetic construct
  misc_feature 1..1977: note = mRNA product Design e-6 comprising derived and/or modified sequence from HRSV(A2)__F_DSCav1_mut2 (opt4)
  source 1..1977: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2588 - RNA, 1977 nt, synthetic construct
  misc_feature 1..1977: note = mRNA product Design e-6 comprising derived and/or modified sequence from HRSV(A2)__F_DSCav1_mut2 (opt5)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2589 - RNA, 1977 nt, synthetic construct
  misc_feature 1..1977: note = mRNA product Design e-6 comprising derived and/or modified sequence from HRSV(A2)__F_DSCav1_mut2 (opt6)
  source 1..1977: mol_type = other RNA
gggagagcggctcggccattttgtcccagtcagtccggaggctgcggctgcagaagtaccgcctgcggagtaactgcaaagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2590 - RNA, 1977 nt, synthetic construct
  misc_feature 1..1977: note = mRNA product Design e-6 comprising derived and/or modified sequence from HRSV(A2)__F_DSCav1_mut2 (opt11)
  source 1..1977: mol_type = other RNA
gggagagcggctcggccattttgtcccagtcagtccggaggctgcggctgcagaagtaccgcctgcggagtaactgcaaagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2591 - RNA, 2193 nt, synthetic construct
  misc_feature 1..2193: note = mRNA product Design f-1 comprising derived and/or modified sequence from HRSV(A2)__F_DSCav1_mut2 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2592 - RNA, 2193 nt, synthetic construct
  misc_feature 1..2193: note = mRNA product Design f-1 comprising derived and/or modified sequence from HRSV(A2)__F_DSCav1_mut2 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2593 - RNA, 2193 nt, synthetic construct
  misc_feature 1..2193: note = mRNA product Design f-1 comprising derived and/or modified sequence from HRSV(A2)__F_DSCav1_mut2 (opt2)
  source 1..2193: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2594 - RNA, 2193 nt, synthetic construct
  misc_feature 1..2193: note = mRNA product Design f-1 comprising derived and/or modified sequence from HRSV(A2)__F_DSCav1_mut2 (opt3)
  source 1..2193: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2595 - RNA, 2193 nt, synthetic construct
  misc_feature 1..2193: note = mRNA product Design f-1 comprising derived and/or modified sequence from HRSV(A2)__F_DSCav1_mut2 (opt4)
  source 1..2193: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2596 - RNA, 2193 nt, synthetic construct
  misc_feature 1..2193: note = mRNA product Design f-1 comprising derived and/or modified sequence from HRSV(A2)__F_DSCav1_mut2 (opt5)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2597 - RNA, 2193 nt, synthetic construct
  misc_feature 1..2193: note = mRNA product Design f-1 comprising derived and/or modified sequence from HRSV(A2)__F_DSCav1_mut2 (opt6)
  source 1..2193: mol_type = other RNA
gggagagcggctcggccattttgtcccagtcagtccggaggctgcggctgcagaagtaccgcctgcggagtaactgcaaagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2598 - RNA, 2193 nt, synthetic construct
  misc_feature 1..2193: note = mRNA product Design f-1 comprising derived and/or modified sequence from HRSV(A2)__F_DSCav1_mut2 (opt11)
  source 1..2193: mol_type = other RNA
gggagagcggctcggccattttgtcccagtcagtccggaggctgcggctgcagaagtaccgcctgcggagtaactgcaaagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2599 - RNA, 1973 nt, synthetic construct
  misc_feature 1..1973: note = mRNA product Design f-2 comprising derived and/or modified sequence from HRSV(A2)__F_DSCav1_mut2 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2600 - RNA, 1973 nt, synthetic construct
  misc_feature 1..1973: note = mRNA product Design f-2 comprising derived and/or modified sequence from HRSV(A2)__F_DSCav1_mut2 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2601 - RNA, 1973 nt, synthetic construct
  misc_feature 1..1973: note = mRNA product Design f-2 comprising derived and/or modified sequence from HRSV(A2)__F_DSCav1_mut2 (opt2)
  source 1..1973: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2602 - RNA, 1973 nt, synthetic construct
  misc_feature 1..1973: note = mRNA product Design f-2 comprising derived and/or modified sequence from HRSV(A2)__F_DSCav1_mut2 (opt3)
  source 1..1973: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2603 - RNA, 1973 nt, synthetic construct
  misc_feature 1..1973: note = mRNA product Design f-2 comprising derived and/or modified sequence from HRSV(A2)__F_DSCav1_mut2 (opt4)
  source 1..1973: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2604 - RNA, 1973 nt, synthetic construct
  misc_feature 1..1973: note = mRNA product Design f-2 comprising derived and/or modified sequence from HRSV(A2)__F_DSCav1_mut2 (opt5)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2605 - RNA, 1973 nt, synthetic construct
  misc_feature 1..1973: note = mRNA product Design f-2 comprising derived and/or modified sequence from HRSV(A2)__F_DSCav1_mut2 (opt6)
  source 1..1973: mol_type = other RNA
gggagagcggctcggccattttgtcccagtcagtccggaggctgcggctgcagaagtaccgcctgcggagtaactgcaaagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2606 - RNA, 1973 nt, synthetic construct
  misc_feature 1..1973: note = mRNA product Design f-2 comprising derived and/or modified sequence from HRSV(A2)__F_DSCav1_mut2 (opt11)
  source 1..1973: mol_type = other RNA
gggagagcggctcggccattttgtcccagtcagtccggaggctgcggctgcagaagtaccgcctgcggagtaactgcaaagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2607 - RNA, 1964 nt, synthetic construct
  misc_feature 1..1964: note = mRNA product Design f-3 comprising derived and/or modified sequence from HRSV(A2)__F_DSCav1_mut2 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2608 - RNA, 1964 nt, synthetic construct
  misc_feature 1..1964: note = mRNA product Design f-3 comprising derived and/or modified sequence from HRSV(A2)__F_DSCav1_mut2 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2609 - RNA, 1964 nt, synthetic construct
  misc_feature 1..1964: note = mRNA product Design f-3 comprising derived and/or modified sequence from HRSV(A2)__F_DSCav1_mut2 (opt2)
  source 1..1964: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2610 - RNA, 1964 nt, synthetic construct
  misc_feature 1..1964: note = mRNA product Design f-3 comprising derived and/or modified sequence from HRSV(A2)__F_DSCav1_mut2 (opt3)
  source 1..1964: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2611 - RNA, 1964 nt, synthetic construct
  misc_feature 1..1964: note = mRNA product Design f-3 comprising derived and/or modified sequence from HRSV(A2)__F_DSCav1_mut2 (opt4)
  source 1..1964: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2612 - RNA, 1964 nt, synthetic construct
  misc_feature 1..1964: note = mRNA product Design f-3 comprising derived and/or modified sequence from HRSV(A2)__F_DSCav1_mut2 (opt5)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2613 - RNA, 1964 nt, synthetic construct
  misc_feature 1..1964: note = mRNA product Design f-3 comprising derived and/or modified sequence from HRSV(A2)__F_DSCav1_mut2 (opt6)
  source 1..1964: mol_type = other RNA
gggagagtcccgcagtcggcgtccagcggctctgcttgttcgtgtgtgtgtcgttgcaggccttattcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2614 - RNA, 1964 nt, synthetic construct
  misc_feature 1..1964: note = mRNA product Design f-3 comprising derived and/or modified sequence from HRSV(A2)__F_DSCav1_mut2 (opt11)
  source 1..1964: mol_type = other RNA
gggagagtcccgcagtcggcgtccagcggctctgcttgttcgtgtgtgtgtcgttgcaggccttattcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2615 - RNA, 2180 nt, synthetic construct
  misc_feature 1..2180: note = mRNA product Design f-4 comprising derived and/or modified sequence from HRSV(A2)__F_DSCav1_mut2 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2616 - RNA, 2180 nt, synthetic construct
  misc_feature 1..2180: note = mRNA product Design f-4 comprising derived and/or modified sequence from HRSV(A2)__F_DSCav1_mut2 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2617 - RNA, 2180 nt, synthetic construct
  misc_feature 1..2180: note = mRNA product Design f-4 comprising derived and/or modified sequence from HRSV(A2)__F_DSCav1_mut2 (opt2)
  source 1..2180: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2618 - RNA, 2180 nt, synthetic construct
  misc_feature 1..2180: note = mRNA product Design f-4 comprising derived and/or modified sequence from HRSV(A2)__F_DSCav1_mut2 (opt3)
  source 1..2180: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2619 - RNA, 2180 nt, synthetic construct
  misc_feature 1..2180: note = mRNA product Design f-4 comprising derived and/or modified sequence from HRSV(A2)__F_DSCav1_mut2 (opt4)
  source 1..2180: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2620 - RNA, 2180 nt, synthetic construct
  misc_feature 1..2180: note = mRNA product Design f-4 comprising derived and/or modified sequence from HRSV(A2)__F_DSCav1_mut2 (opt5)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2621 - RNA, 2180 nt, synthetic construct
  misc_feature 1..2180: note = mRNA product Design f-4 comprising derived and/or modified sequence from HRSV(A2)__F_DSCav1_mut2 (opt6)
  source 1..2180: mol_type = other RNA
gggagagtcccgcagtcggcgtccagcggctctgcttgttcgtgtgtgtgtcgttgcaggccttattcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2622 - RNA, 2180 nt, synthetic construct
  misc_feature 1..2180: note = mRNA product Design f-4 comprising derived and/or modified sequence from HRSV(A2)__F_DSCav1_mut2 (opt11)
  source 1..2180: mol_type = other RNA
gggagagtcccgcagtcggcgtccagcggctctgcttgttcgtgtgtgtgtcgttgcaggccttattcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2623 - RNA, 1956 nt, synthetic construct
  misc_feature 1..1956: note = mRNA product Design f-5 comprising derived and/or modified sequence from HRSV(A2)__F_DSCav1_mut2 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2624 - RNA, 1956 nt, synthetic construct
  misc_feature 1..1956: note = mRNA product Design f-5 comprising derived and/or modified sequence from HRSV(A2)__F_DSCav1_mut2 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2625 - RNA, 1956 nt, synthetic construct
  misc_feature 1..1956: note = mRNA product Design f-5 comprising derived and/or modified sequence from HRSV(A2)__F_DSCav1_mut2 (opt2)
  source 1..1956: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2626 - RNA, 1956 nt, synthetic construct
  misc_feature 1..1956: note = mRNA product Design f-5 comprising derived and/or modified sequence from HRSV(A2)__F_DSCav1_mut2 (opt3)
  source 1..1956: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2627 - RNA, 1956 nt, synthetic construct
  misc_feature 1..1956: note = mRNA product Design f-5 comprising derived and/or modified sequence from HRSV(A2)__F_DSCav1_mut2 (opt4)
  source 1..1956: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2628 - RNA, 1956 nt, synthetic construct
  misc_feature 1..1956: note = mRNA product Design f-5 comprising derived and/or modified sequence from HRSV(A2)__F_DSCav1_mut2 (opt5)
  source 1..1956: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2629 - RNA, 1956 nt, synthetic construct
  misc_feature 1..1956: note = mRNA product Design f-5 comprising derived and/or modified sequence from HRSV(A2)__F_DSCav1_mut2 (opt6)
  source 1..1956: mol_type = other RNA
gggagactttcccattctgtagcagaatttggtgttgcctgtggtcttggtcccgcggagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2630 - RNA, 1956 nt, synthetic construct
  misc_feature 1..1956: note = mRNA product Design f-5 comprising derived and/or modified sequence from HRSV(A2)__F_DSCav1_mut2 (opt11)
  source 1..1956: mol_type = other RNA
gggagactttcccattctgtagcagaatttggtgttgcctgtggtcttggtcccgcggagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2631 - RNA, 1952 nt, synthetic construct
  misc_feature 1..1952: note = mRNA product Design g-1 comprising derived and/or modified sequence from HRSV(A2)__F_DSCav1_mut2 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2632 - RNA, 1952 nt, synthetic construct
  misc_feature 1..1952: note = mRNA product Design g-1 comprising derived and/or modified sequence from HRSV(A2)__F_DSCav1_mut2 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2633 - RNA, 1952 nt, synthetic construct
  misc_feature 1..1952: note = mRNA product Design g-1 comprising derived and/or modified sequence from HRSV(A2)__F_DSCav1_mut2 (opt2)
  source 1..1952: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2634 - RNA, 1952 nt, synthetic construct
  misc_feature 1..1952: note = mRNA product Design g-1 comprising derived and/or modified sequence from HRSV(A2)__F_DSCav1_mut2 (opt3)
  source 1..1952: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2635 - RNA, 1952 nt, synthetic construct
  misc_feature 1..1952: note = mRNA product Design g-1 comprising derived and/or modified sequence from HRSV(A2)__F_DSCav1_mut2 (opt4)
  source 1..1952: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2636 - RNA, 1952 nt, synthetic construct
  misc_feature 1..1952: note = mRNA product Design g-1 comprising derived and/or modified sequence from HRSV(A2)__F_DSCav1_mut2 (opt5)
  source 1..1952: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2637 - RNA, 1952 nt, synthetic construct
  misc_feature 1..1952: note = mRNA product Design g-1 comprising derived and/or modified sequence from HRSV(A2)__F_DSCav1_mut2 (opt6)
  source 1..1952: mol_type = other RNA
gggagactttcccattctgtagcagaatttggtgttgcctgtggtcttggtcccgcggagaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2638 - RNA, 1952 nt, synthetic construct
  misc_feature 1..1952: note = mRNA product Design g-1 comprising derived and/or modified sequence from HRSV(A2)__F_DSCav1_mut2 (opt11)
  source 1..1952: mol_type = other RNA
gggagactttcccattctgtagcagaatttggtgttgcctgtggtcttggtcccgcggagaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2639 - RNA, 1967 nt, synthetic construct
  misc_feature 1..1967: note = mRNA product Design g-2 comprising derived and/or modified sequence from HRSV(A2)__F_DSCav1_mut2 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2640 - RNA, 1967 nt, synthetic construct
  misc_feature 1..1967: note = mRNA product Design g-2 comprising derived and/or modified sequence from HRSV(A2)__F_DSCav1_mut2 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2641 - RNA, 1967 nt, synthetic construct
  misc_feature 1..1967: note = mRNA product Design g-2 comprising derived and/or modified sequence from HRSV(A2)__F_DSCav1_mut2 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2642 - RNA, 1967 nt, synthetic construct
  misc_feature 1..1967: note = mRNA product Design g-2 comprising derived and/or modified sequence from HRSV(A2)__F_DSCav1_mut2 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2643 - RNA, 1967 nt, synthetic construct
  misc_feature 1..1967: note = mRNA product Design g-2 comprising derived and/or modified sequence from HRSV(A2)__F_DSCav1_mut2 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2644 - RNA, 1967 nt, synthetic construct
  misc_feature 1..1967: note = mRNA product Design g-2 comprising derived and/or modified sequence from HRSV(A2)__F_DSCav1_mut2 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2645 - RNA, 1967 nt, synthetic construct
  misc_feature 1..1967: note = mRNA product Design g-2 comprising derived and/or modified sequence from HRSV(A2)__F_DSCav1_mut2 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2646 - RNA, 1967 nt, synthetic construct
  misc_feature 1..1967: note = mRNA product Design g-2 comprising derived and/or modified sequence from HRSV(A2)__F_DSCav1_mut2 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2647 - RNA, 2199 nt, synthetic construct
  misc_feature 1..2199: note = mRNA product Design g-3 comprising derived and/or modified sequence from HRSV(A2)__F_DSCav1_mut2 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2648 - RNA, 2199 nt, synthetic construct
  misc_feature 1..2199: note = mRNA product Design g-3 comprising derived and/or modified sequence from HRSV(A2)__F_DSCav1_mut2 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2649 - RNA, 2199 nt, synthetic construct
  misc_feature 1..2199: note = mRNA product Design g-3 comprising derived and/or modified sequence from HRSV(A2)__F_DSCav1_mut2 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2650 - RNA, 2199 nt, synthetic construct
  misc_feature 1..2199: note = mRNA product Design g-3 comprising derived and/or modified sequence from HRSV(A2)__F_DSCav1_mut2 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2651 - RNA, 2199 nt, synthetic construct
  misc_feature 1..2199: note = mRNA product Design g-3 comprising derived and/or modified sequence from HRSV(A2)__F_DSCav1_mut2 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2652 - RNA, 2199 nt, synthetic construct
  misc_feature 1..2199: note = mRNA product Design g-3 comprising derived and/or modified sequence from HRSV(A2)__F_DSCav1_mut2 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2653 - RNA, 2199 nt, synthetic construct
  misc_feature 1..2199: note = mRNA product Design g-3 comprising derived and/or modified sequence from HRSV(A2)__F_DSCav1_mut2 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2654 - RNA, 2199 nt, synthetic construct
  misc_feature 1..2199: note = mRNA product Design g-3 comprising derived and/or modified sequence from HRSV(A2)__F_DSCav1_mut2 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2655 - RNA, 1994 nt, synthetic construct
  misc_feature 1..1994: note = mRNA product Design g-4 comprising derived and/or modified sequence from HRSV(A2)__F_DSCav1_mut2 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2656 - RNA, 1994 nt, synthetic construct
  misc_feature 1..1994: note = mRNA product Design g-4 comprising derived and/or modified sequence from HRSV(A2)__F_DSCav1_mut2 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2657 - RNA, 1994 nt, synthetic construct
  misc_feature 1..1994: note = mRNA product Design g-4 comprising derived and/or modified sequence from HRSV(A2)__F_DSCav1_mut2 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2658 - RNA, 1994 nt, synthetic construct
  misc_feature 1..1994: note = mRNA product Design g-4 comprising derived and/or modified sequence from HRSV(A2)__F_DSCav1_mut2 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2659 - RNA, 1994 nt, synthetic construct
  misc_feature 1..1994: note = mRNA product Design g-4 comprising derived and/or modified sequence from HRSV(A2)__F_DSCav1_mut2 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2660 - RNA, 1994 nt, synthetic construct
  misc_feature 1..1994: note = mRNA product Design g-4 comprising derived and/or modified sequence from HRSV(A2)__F_DSCav1_mut2 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2661 - RNA, 1994 nt, synthetic construct
  misc_feature 1..1994: note = mRNA product Design g-4 comprising derived and/or modified sequence from HRSV(A2)__F_DSCav1_mut2 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2662 - RNA, 1994 nt, synthetic construct
  misc_feature 1..1994: note = mRNA product Design g-4 comprising derived and/or modified sequence from HRSV(A2)__F_DSCav1_mut2 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2663 - RNA, 1970 nt, synthetic construct
  misc_feature 1..1970: note = mRNA product Design g-5 comprising derived and/or modified sequence from HRSV(A2)__F_DSCav1_mut2 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2664 - RNA, 1970 nt, synthetic construct
  misc_feature 1..1970: note = mRNA product Design g-5 comprising derived and/or modified sequence from HRSV(A2)__F_DSCav1_mut2 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2665 - RNA, 1970 nt, synthetic construct
  misc_feature 1..1970: note = mRNA product Design g-5 comprising derived and/or modified sequence from HRSV(A2)__F_DSCav1_mut2 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2666 - RNA, 1970 nt, synthetic construct
  misc_feature 1..1970: note = mRNA product Design g-5 comprising derived and/or modified sequence from HRSV(A2)__F_DSCav1_mut2 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2667 - RNA, 1970 nt, synthetic construct
  misc_feature 1..1970: note = mRNA product Design g-5 comprising derived and/or modified sequence from HRSV(A2)__F_DSCav1_mut2 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2668 - RNA, 1970 nt, synthetic construct
  misc_feature 1..1970: note = mRNA product Design g-5 comprising derived and/or modified sequence from HRSV(A2)__F_DSCav1_mut2 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2669 - RNA, 1970 nt, synthetic construct
  misc_feature 1..1970: note = mRNA product Design g-5 comprising derived and/or modified sequence from HRSV(A2)__F_DSCav1_mut2 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2670 - RNA, 1970 nt, synthetic construct
  misc_feature 1..1970: note = mRNA product Design g-5 comprising derived and/or modified sequence from HRSV(A2)__F_DSCav1_mut2 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2671 - RNA, 1986 nt, synthetic construct
  misc_feature 1..1986: note = mRNA product Design h-1 comprising derived and/or modified sequence from HRSV(A2)__F_DSCav1_mut2 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2672 - RNA, 1986 nt, synthetic construct
  misc_feature 1..1986: note = mRNA product Design h-1 comprising derived and/or modified sequence from HRSV(A2)__F_DSCav1_mut2 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2673 - RNA, 1986 nt, synthetic construct
  misc_feature 1..1986: note = mRNA product Design h-1 comprising derived and/or modified sequence from HRSV(A2)__F_DSCav1_mut2 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2674 - RNA, 1986 nt, synthetic construct
  misc_feature 1..1986: note = mRNA product Design h-1 comprising derived and/or modified sequence from HRSV(A2)__F_DSCav1_mut2 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2675 - RNA, 1986 nt, synthetic construct
  misc_feature 1..1986: note = mRNA product Design h-1 comprising derived and/or modified sequence from HRSV(A2)__F_DSCav1_mut2 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2676 - RNA, 1986 nt, synthetic construct
  misc_feature 1..1986: note = mRNA product Design h-1 comprising derived and/or modified sequence from HRSV(A2)__F_DSCav1_mut2 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2677 - RNA, 1986 nt, synthetic construct
  misc_feature 1..1986: note = mRNA product Design h-1 comprising derived and/or modified sequence from HRSV(A2)__F_DSCav1_mut2 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2678 - RNA, 1986 nt, synthetic construct
  misc_feature 1..1986: note = mRNA product Design h-1 comprising derived and/or modified sequence from HRSV(A2)__F_DSCav1_mut2 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2679 - RNA, 2202 nt, synthetic construct
  misc_feature 1..2202: note = mRNA product Design h-2 comprising derived and/or modified sequence from HRSV(A2)__F_DSCav1_mut2 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2680 - RNA, 2202 nt, synthetic construct
  misc_feature 1..2202: note = mRNA product Design h-2 comprising derived and/or modified sequence from HRSV(A2)__F_DSCav1_mut2 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2681 - RNA, 2202 nt, synthetic construct
  misc_feature 1..2202: note = mRNA product Design h-2 comprising derived and/or modified sequence from HRSV(A2)__F_DSCav1_mut2 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2682 - RNA, 2202 nt, synthetic construct
  misc_feature 1..2202: note = mRNA product Design h-2 comprising derived and/or modified sequence from HRSV(A2)__F_DSCav1_mut2 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2683 - RNA, 2202 nt, synthetic construct
  misc_feature 1..2202: note = mRNA product Design h-2 comprising derived and/or modified sequence from HRSV(A2)__F_DSCav1_mut2 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2684 - RNA, 2202 nt, synthetic construct
  misc_feature 1..2202: note = mRNA product Design h-2 comprising derived and/or modified sequence from HRSV(A2)__F_DSCav1_mut2 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2685 - RNA, 2202 nt, synthetic construct
  misc_feature 1..2202: note = mRNA product Design h-2 comprising derived and/or modified sequence from HRSV(A2)__F_DSCav1_mut2 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2686 - RNA, 2202 nt, synthetic construct
  misc_feature 1..2202: note = mRNA product Design h-2 comprising derived and/or modified sequence from HRSV(A2)__F_DSCav1_mut2 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2687 - RNA, 1982 nt, synthetic construct
  misc_feature 1..1982: note = mRNA product Design h-3 comprising derived and/or modified sequence from HRSV(A2)__F_DSCav1_mut2 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2688 - RNA, 1982 nt, synthetic construct
  misc_feature 1..1982: note = mRNA product Design h-3 comprising derived and/or modified sequence from HRSV(A2)__F_DSCav1_mut2 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2689 - RNA, 1982 nt, synthetic construct
  misc_feature 1..1982: note = mRNA product Design h-3 comprising derived and/or modified sequence from HRSV(A2)__F_DSCav1_mut2 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2690 - RNA, 1982 nt, synthetic construct
  misc_feature 1..1982: note = mRNA product Design h-3 comprising derived and/or modified sequence from HRSV(A2)__F_DSCav1_mut2 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2691 - RNA, 1982 nt, synthetic construct
  misc_feature 1..1982: note = mRNA product Design h-3 comprising derived and/or modified sequence from HRSV(A2)__F_DSCav1_mut2 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2692 - RNA, 1982 nt, synthetic construct
  misc_feature 1..1982: note = mRNA product Design h-3 comprising derived and/or modified sequence from HRSV(A2)__F_DSCav1_mut2 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2693 - RNA, 1982 nt, synthetic construct
  misc_feature 1..1982: note = mRNA product Design h-3 comprising derived and/or modified sequence from HRSV(A2)__F_DSCav1_mut2 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2694 - RNA, 1982 nt, synthetic construct
  misc_feature 1..1982: note = mRNA product Design h-3 comprising derived and/or modified sequence from HRSV(A2)__F_DSCav1_mut2 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2695 - RNA, 2045 nt, synthetic construct
  misc_feature 1..2045: note = mRNA product Design h-4 comprising derived and/or modified sequence from HRSV(A2)__F_DSCav1_mut2 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2696 - RNA, 2045 nt, synthetic construct
  misc_feature 1..2045: note = mRNA product Design h-4 comprising derived and/or modified sequence from HRSV(A2)__F_DSCav1_mut2 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2697 - RNA, 2045 nt, synthetic construct
  misc_feature 1..2045: note = mRNA product Design h-4 comprising derived and/or modified sequence from HRSV(A2)__F_DSCav1_mut2 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2698 - RNA, 2045 nt, synthetic construct
  misc_feature 1..2045: note = mRNA product Design h-4 comprising derived and/or modified sequence from HRSV(A2)__F_DSCav1_mut2 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2699 - RNA, 2045 nt, synthetic construct
  misc_feature 1..2045: note = mRNA product Design h-4 comprising derived and/or modified sequence from HRSV(A2)__F_DSCav1_mut2 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2700 - RNA, 2045 nt, synthetic construct
  misc_feature 1..2045: note = mRNA product Design h-4 comprising derived and/or modified sequence from HRSV(A2)__F_DSCav1_mut2 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2701 - RNA, 2045 nt, synthetic construct
  misc_feature 1..2045: note = mRNA product Design h-4 comprising derived and/or modified sequence from HRSV(A2)__F_DSCav1_mut2 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2702 - RNA, 2045 nt, synthetic construct
  misc_feature 1..2045: note = mRNA product Design h-4 comprising derived and/or modified sequence from HRSV(A2)__F_DSCav1_mut2 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2703 - RNA, 2061 nt, synthetic construct
  misc_feature 1..2061: note = mRNA product Design h-5 comprising derived and/or modified sequence from HRSV(A2)__F_DSCav1_mut2 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2704 - RNA, 2061 nt, synthetic construct
  misc_feature 1..2061: note = mRNA product Design h-5 comprising derived and/or modified sequence from HRSV(A2)__F_DSCav1_mut2 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2705 - RNA, 2061 nt, synthetic construct
  misc_feature 1..2061: note = mRNA product Design h-5 comprising derived and/or modified sequence from HRSV(A2)__F_DSCav1_mut2 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2706 - RNA, 2061 nt, synthetic construct
  misc_feature 1..2061: note = mRNA product Design h-5 comprising derived and/or modified sequence from HRSV(A2)__F_DSCav1_mut2 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2707 - RNA, 2061 nt, synthetic construct
  misc_feature 1..2061: note = mRNA product Design h-5 comprising derived and/or modified sequence from HRSV(A2)__F_DSCav1_mut2 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2708 - RNA, 2061 nt, synthetic construct
  misc_feature 1..2061: note = mRNA product Design h-5 comprising derived and/or modified sequence from HRSV(A2)__F_DSCav1_mut2 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2709 - RNA, 2061 nt, synthetic construct
  misc_feature 1..2061: note = mRNA product Design h-5 comprising derived and/or modified sequence from HRSV(A2)__F_DSCav1_mut2 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2710 - RNA, 2061 nt, synthetic construct
  misc_feature 1..2061: note = mRNA product Design h-5 comprising derived and/or modified sequence from HRSV(A2)__F_DSCav1_mut2 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2711 - RNA, 1994 nt, synthetic construct
  misc_feature 1..1994: note = mRNA product Design i-1 comprising derived and/or modified sequence from HRSV(A2)__F_DSCav1_mut2 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2712 - RNA, 1994 nt, synthetic construct
  misc_feature 1..1994: note = mRNA product Design i-1 comprising derived and/or modified sequence from HRSV(A2)__F_DSCav1_mut2 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2713 - RNA, 1994 nt, synthetic construct
  misc_feature 1..1994: note = mRNA product Design i-1 comprising derived and/or modified sequence from HRSV(A2)__F_DSCav1_mut2 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2714 - RNA, 1994 nt, synthetic construct
  misc_feature 1..1994: note = mRNA product Design i-1 comprising derived and/or modified sequence from HRSV(A2)__F_DSCav1_mut2 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2715 - RNA, 1994 nt, synthetic construct
  misc_feature 1..1994: note = mRNA product Design i-1 comprising derived and/or modified sequence from HRSV(A2)__F_DSCav1_mut2 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2716 - RNA, 1994 nt, synthetic construct
  misc_feature 1..1994: note = mRNA product Design i-1 comprising derived and/or modified sequence from HRSV(A2)__F_DSCav1_mut2 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2717 - RNA, 1994 nt, synthetic construct
  misc_feature 1..1994: note = mRNA product Design i-1 comprising derived and/or modified sequence from HRSV(A2)__F_DSCav1_mut2 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2718 - RNA, 1994 nt, synthetic construct
  misc_feature 1..1994: note = mRNA product Design i-1 comprising derived and/or modified sequence from HRSV(A2)__F_DSCav1_mut2 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2719 - RNA, 1994 nt, synthetic construct
  misc_feature 1..1994: note = mRNA product Design i-2 comprising derived and/or modified sequence from HRSV(A2)__F_DSCav1_mut2 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2720 - RNA, 1994 nt, synthetic construct
  misc_feature 1..1994: note = mRNA product Design i-2 comprising derived and/or modified sequence from HRSV(A2)__F_DSCav1_mut2 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2721 - RNA, 1994 nt, synthetic construct
  misc_feature 1..1994: note = mRNA product Design i-2 comprising derived and/or modified sequence from HRSV(A2)__F_DSCav1_mut2 (opt2)
  source 1..1994: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2722 - RNA, 1994 nt, synthetic construct
  misc_feature 1..1994: note = mRNA product Design i-2 comprising derived and/or modified sequence from HRSV(A2)__F_DSCav1_mut2 (opt3)
  source 1..1994: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2723 - RNA, 1994 nt, synthetic construct
  misc_feature 1..1994: note = mRNA product Design i-2 comprising derived and/or modified sequence from HRSV(A2)__F_DSCav1_mut2 (opt4)
  source 1..1994: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2724 - RNA, 1994 nt, synthetic construct
  misc_feature 1..1994: note = mRNA product Design i-2 comprising derived and/or modified sequence from HRSV(A2)__F_DSCav1_mut2 (opt5)
  source 1..1994: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2725 - RNA, 1994 nt, synthetic construct
  misc_feature 1..1994: note = mRNA product Design i-2 comprising derived and/or modified sequence from HRSV(A2)__F_DSCav1_mut2 (opt6)
  source 1..1994: mol_type = other RNA
gggagaggcgctgcctacggaggtggcagccatctccttctcggcatcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2726 - RNA, 1994 nt, synthetic construct
  misc_feature 1..1994: note = mRNA product Design i-2 comprising derived and/or modified sequence from HRSV(A2)__F_DSCav1_mut2 (opt11)
  source 1..1994: mol_type = other RNA
gggagaggcgctgcctacggaggtggcagccatctccttctcggcatcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2727 - RNA, 1990 nt, synthetic construct
  misc_feature 1..1990: note = mRNA product Design i-2 comprising derived and/or modified sequence from HRSV(A2)__F_DSCav1_mut2 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2728 - RNA, 1990 nt, synthetic construct
  misc_feature 1..1990: note = mRNA product Design i-2 comprising derived and/or modified sequence from HRSV(A2)__F_DSCav1_mut2 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2729 - RNA, 1990 nt, synthetic construct
  misc_feature 1..1990: note = mRNA product Design i-2 comprising derived and/or modified sequence from HRSV(A2)__F_DSCav1_mut2 (opt2)
  source 1..1990: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2730 - RNA, 1990 nt, synthetic construct
  misc_feature 1..1990: note = mRNA product Design i-2 comprising derived and/or modified sequence from HRSV(A2)__F_DSCav1_mut2 (opt3)
  source 1..1990: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2731 - RNA, 1990 nt, synthetic construct
  misc_feature 1..1990: note = mRNA product Design i-2 comprising derived and/or modified sequence from HRSV(A2)__F_DSCav1_mut2 (opt4)
  source 1..1990: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2732 - RNA, 1990 nt, synthetic construct
  misc_feature 1..1990: note = mRNA product Design i-2 comprising derived and/or modified sequence from HRSV(A2)__F_DSCav1_mut2 (opt5)
  source 1..1990: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2733 - RNA, 1990 nt, synthetic construct
  misc_feature 1..1990: note = mRNA product Design i-2 comprising derived and/or modified sequence from HRSV(A2)__F_DSCav1_mut2 (opt6)
  source 1..1990: mol_type = other RNA
ggggcgctgcctacggaggtggcagccatctccttctcggcatcaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2734 - RNA, 1990 nt, synthetic construct
  misc_feature 1..1990: note = mRNA product Design i-2 comprising derived and/or modified sequence from HRSV(A2)__F_DSCav1_mut2 (opt11)
  source 1..1990: mol_type = other RNA
ggggcgctgcctacggaggtggcagccatctccttctcggcatcaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2735 - RNA, 1825 nt, synthetic construct
  misc_feature 1..1825: note = mRNA product Design i-3 comprising derived and/or modified sequence from HRSV(A2)__F_DSCav1_mut2 (opt1) R6772
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2736 - RNA, 1825 nt, synthetic construct
  misc_feature 1..1825: note = mRNA product Design i-3 comprising derived and/or modified sequence from HRSV(A2)__F_DSCav1_mut2 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2737 - RNA, 1825 nt, synthetic construct
  misc_feature 1..1825: note = mRNA product Design i-3 comprising derived and/or modified sequence from HRSV(A2)__F_DSCav1_mut2 (opt2)
  source 1..1825: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2738 - RNA, 1825 nt, synthetic construct
  misc_feature 1..1825: note = mRNA product Design i-3 comprising derived and/or modified sequence from HRSV(A2)__F_DSCav1_mut2 (opt3)
  source 1..1825: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctcaacacccgtgaccctgagtaaagatcaactctctgggataaacaatatcgcattcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2739 - RNA, 1825 nt, synthetic construct
  misc_feature 1..1825: note = mRNA product Design i-3 comprising derived and/or modified sequence from HRSV(A2)__F_DSCav1_mut2 (opt4)
  source 1..1825: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2740 - RNA, 1825 nt, synthetic construct
  misc_feature 1..1825: note = mRNA product Design i-3 comprising derived and/or modified sequence from HRSV(A2)__F_DSCav1_mut2 (opt5)
  source 1..1825: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagaagcacacccgtgaccctttctaaagatcaactctccggaattaacaatatcgctttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2741 - RNA, 1825 nt, synthetic construct
  misc_feature 1..1825: note = mRNA product Design i-3 comprising derived and/or modified sequence from HRSV(A2)__F_DSCav1_mut2 (opt6)
  source 1..1825: mol_type = other RNA
gggagaaagcttaccatggaactactaatcctaaaagcaaacgcaattacaactatacttaccgccgtaacattttgcttcgcatctgggcaaaacattaccgaagaattttatcaatcaacatgctcagcagtctccaaaggataccttggagcattaagaaccggctggtatacctccgtaataacaattgaactatctaatataaaagaaaataaatgtaatggaactgacgcaaaagttaaactaataaaacaagaactcgacaaatacaaaaacgccgtcacagacctacaactactaatgcaatcaacccccgcaacaggatcaggatccgcaatctgcagcggcgtcgcagtttgcaaagtcctacatttagaaggagaagtaaacaaaataaaatctgctctcctctctacaaacaaagcagtagtgtcactttcaaacggagtatcagttctaacattcaaagtactagacctaaaaaattacatagacaaacaactacttccaattctaaacaaacaatcctgttccatacccaacatagaaacagtaatagaatttcaacaaaaaaataacagactcctagaaattacaagagaattttccgtcaatgcaggagtaacaaccccagtatcaacctacatgttaactaactcagaactcttatcactaataaacgacatgccaatcactaatgaccaaaaaaaactcatgtcaaataacgtacaaatagtccgacaacaatcatactccatcatgtgcattataaaagaagaagtactagcatacgtcgtccaattaccactatacggcgtcatagacacaccatgttggaaactccacacatcaccactatgcactacaaatacaaaagaaggctccaacatctgcctaacaagaacagacagaggttggtattgcgacaacgcaggatcagtatcatttttcccccaagcagaaacatgtaaagtacaatcaaatagagtcttctgcgacaccatgaactcattaacactaccttcagaagtcaacctatgcaacgtagacatcttcaaccctaaatatgactgcaaaatcatgaccagcaaaaccgacgtttcatcttccgtaataacatcactaggcgcaatagtctcatgttacggcaaaacaaaatgtacagcatcaaataaaaaccgtggaataataaaaacattttctaatggttgtgactacgtaagcaataaaggagtagatacagtatcagtcggcaacaccttatactgtgtaaacaaacaagaaggccaaagtttatacgtcaaaggagaacccatcatcaacttctacgacccattagtattcccatcagacgaatttgatgcaagcatttcacaagtcaacgaaaaaatcaatcaatcattagcattcatccgaaaatcagacgaattattacacaacgtaaacgccggaaaatcaaccactaatataatgataaccacaataatcatcgtaataatagtaatacttctctcactaatcgcagtcggactccttctatactgcaaagcaagatctacaccagtaacactatccaaagatcaactaagtggcataaacaacatagcattttctaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2742 - RNA, 1825 nt, synthetic construct
  misc_feature 1..1825: note = mRNA product Design i-3 comprising derived and/or modified sequence from HRSV(A2)__F_DSCav1_mut2 (opt11)
  source 1..1825: mol_type = other RNA
gggagaaagcttaccatggaactcctcatcctaaaagccaacgcgatcaccacaatcctgacagccgtcaccttctgcttcgcctccggccaaaacatcaccgaagagttctaccaatccacatgctccgccgtctccaagggctacctgggcgcacttcgtacaggctggtacacctccgtaataaccatcgaactctccaacatcaaagaaaacaaatgcaacggcacagacgcaaaagtcaaactcatcaagcaagaacttgacaaatacaaaaatgcagtcaccgaccttcaactcctcatgcaatctacccccgccacaggctccggctccgctatctgctccggcgtcgccgtctgcaaagtcctccacctcgaaggtgaagtaaacaaaataaaatccgccctcctctccaccaacaaagccgtcgtctccctatcaaacggcgtctccgtgctcaccttcaaggttctcgacctgaaaaactacatagacaaacagctcctaccaatccttaacaaacagagctgctccattccgaatatcgaaacggtaatcgaatttcaacagaaaaacaaccgcctcctcgaaataacgcgagagttctccgtaaacgctggcgtcaccacacccgtcagcacctacatgctaacgaactccgaactcttgtcgctcatcaacgacatgcccataaccaacgaccaaaagaaactaatgtccaataacgtacaaatcgtacgccaacaatcttactccatcatgtgcatcataaaagaagaagtactagcttacgtcgtccaactcccactgtacggagtcatcgacaccccctgctggaaactccacacctctcccctctgcaccaccaacaccaaagagggctccaacatttgcctgacacgcaccgaccgcggctggtactgcgacaacgcaggctccgtctcgttcttcccccaagccgaaacctgcaaagtccaatccaaccgcgtcttctgcgacaccatgaactccctcaccctcccctccgaagtcaatctatgcaacgtagacatcttcaacccgaaatatgactgcaaaattatgacatctaaaaccgacgtgtcctcctcagtcatcacttccctaggagccatcgtttcctgttacggcaagaccaaatgcaccgccagcaacaaaaaccgaggcatcatcaaaaccttctccaacggatgtgactatgtctccaacaagggcgtcgacaccgtcagcgtcggcaacaccctctactgcgtcaacaaacaagaaggccaatccctctacgtcaaaggagagcccataatcaacttctacgaccccctcgtcttcccatccgacgagttcgacgcctcaatctcccaagtcaacgagaaaatcaaccaatccttagccttcatccgtaagtccgacgaactccttcacaacgtcaacgccggtaaatctaccaccaacatcatgataacaacaataattatcgtcatcatcgtcatcctcctttccctcatcgcggtcgggctattgctctactgcaaagcccggtccaccccagtaaccctctctaaagaccaactcagcggaatcaataacatagccttcagcaattaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2743 - protein, 514 aa, synthetic construct
  REGION 1..514: note = derived and/or modified protein sequence (artificial) from HRSV(A2)__F-del_DSCav1_mut2
MELLILKANAITTILTAVTFCFASGQNITEEFYQSTCSAVSKGYLGALRTGWYTSVITIELSNIKENKCNGTDAKVKLIKQELDKYKNAVTDLQLLMQSTPATGSGSAICSGVAVCKVLHLEGEVNKIKSALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 2744 - RNA, 1545 nt, synthetic construct
  misc_feature 1..1545: note = derived and/or modified CDS sequence (opt1) from HRSV(A2)__F-del_DSCav1_mut2
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 2745 - RNA, 1545 nt, synthetic construct
  misc_feature 1..1545: note = derived and/or modified CDS sequence (opt1) from HRSV(A2)__F-del_DSCav1_mut2
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtga

SEQ ID NO: 2746 - RNA, 1545 nt, synthetic construct
  misc_feature 1..1545: note = derived and/or modified CDS sequence (opt2) from HRSV(A2)__F-del_DSCav1_mut2
  source 1..1545: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 2747 - RNA, 1545 nt, synthetic construct
  misc_feature 1..1545: note = derived and/or modified CDS sequence (opt3) from HRSV(A2)__F-del_DSCav1_mut2
  source 1..1545: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctga

SEQ ID NO: 2748 - RNA, 1545 nt, synthetic construct
  misc_feature 1..1545: note = derived and/or modified CDS sequence (opt4) from HRSV(A2)__F-del_DSCav1_mut2
  source 1..1545: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 2749 - RNA, 1545 nt, synthetic construct
  misc_feature 1..1545: note = derived and/or modified CDS sequence (opt5) from HRSV(A2)__F-del_DSCav1_mut2
  source 1..1545: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatga

SEQ ID NO: 2750 - RNA, 1545 nt, synthetic construct
  misc_feature 1..1545: note = derived and/or modified CDS sequence (opt6) from HRSV(A2)__F-del_DSCav1_mut2
  source 1..1545: mol_type = other RNA
atggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataa

SEQ ID NO: 2751 - RNA, 1545 nt, synthetic construct
  misc_feature 1..1545: note = derived and/or modified CDS sequence (opt11) from HRSV(A2)__F-del_DSCav1_mut2
  source 1..1545: mol_type = other RNA
atggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaa

SEQ ID NO: 2752 - RNA, 1821 nt, synthetic construct
  misc_feature 1..1821: note = mRNA product Design a-1 comprising derived and/or modified sequence from HRSV(A2)__F-del_DSCav1_mut2 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2753 - RNA, 1821 nt, synthetic construct
  misc_feature 1..1821: note = mRNA product Design a-1 comprising derived and/or modified sequence from HRSV(A2)__F-del_DSCav1_mut2 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2754 - RNA, 1821 nt, synthetic construct
  misc_feature 1..1821: note = mRNA product Design a-1 comprising derived and/or modified sequence from HRSV(A2)__F-del_DSCav1_mut2 (opt2)
  source 1..1821: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2755 - RNA, 1821 nt, synthetic construct
  misc_feature 1..1821: note = mRNA product Design a-1 comprising derived and/or modified sequence from HRSV(A2)__F-del_DSCav1_mut2 (opt3)
  source 1..1821: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2756 - RNA, 1821 nt, synthetic construct
  misc_feature 1..1821: note = mRNA product Design a-1 comprising derived and/or modified sequence from HRSV(A2)__F-del_DSCav1_mut2 (opt4)
  source 1..1821: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2757 - RNA, 1821 nt, synthetic construct
  misc_feature 1..1821: note = mRNA product Design a-1 comprising derived and/or modified sequence from HRSV(A2)__F-del_DSCav1_mut2 (opt5)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2758 - RNA, 1821 nt, synthetic construct
  misc_feature 1..1821: note = mRNA product Design a-1 comprising derived and/or modified sequence from HRSV(A2)__F-del_DSCav1_mut2 (opt6)
  source 1..1821: mol_type = other RNA
gggagagtcccgcagtcggcgtccagcggctctgcttgttcgtgtgtgtgtcgttgcaggccttattcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2759 - RNA, 1821 nt, synthetic construct
  misc_feature 1..1821: note = mRNA product Design a-1 comprising derived and/or modified sequence from HRSV(A2)__F-del_DSCav1_mut2 (opt11)
  source 1..1821: mol_type = other RNA
gggagagtcccgcagtcggcgtccagcggctctgcttgttcgtgtgtgtgtcgttgcaggccttattcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2760 - RNA, 1840 nt, synthetic construct
  misc_feature 1..1840: note = mRNA product Design a-2 comprising derived and/or modified sequence from HRSV(A2)__F-del_DSCav1_mut2 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2761 - RNA, 1840 nt, synthetic construct
  misc_feature 1..1840: note = mRNA product Design a-2 comprising derived and/or modified sequence from HRSV(A2)__F-del_DSCav1_mut2 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2762 - RNA, 1840 nt, synthetic construct
  misc_feature 1..1840: note = mRNA product Design a-2 comprising derived and/or modified sequence from HRSV(A2)__F-del_DSCav1_mut2 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2763 - RNA, 1840 nt, synthetic construct
  misc_feature 1..1840: note = mRNA product Design a-2 comprising derived and/or modified sequence from HRSV(A2)__F-del_DSCav1_mut2 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2764 - RNA, 1840 nt, synthetic construct
  misc_feature 1..1840: note = mRNA product Design a-2 comprising derived and/or modified sequence from HRSV(A2)__F-del_DSCav1_mut2 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2765 - RNA, 1840 nt, synthetic construct
  misc_feature 1..1840: note = mRNA product Design a-2 comprising derived and/or modified sequence from HRSV(A2)__F-del_DSCav1_mut2 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2766 - RNA, 1840 nt, synthetic construct
  misc_feature 1..1840: note = mRNA product Design a-2 comprising derived and/or modified sequence from HRSV(A2)__F-del_DSCav1_mut2 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2767 - RNA, 1840 nt, synthetic construct
  misc_feature 1..1840: note = mRNA product Design a-2 comprising derived and/or modified sequence from HRSV(A2)__F-del_DSCav1_mut2 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2768 - RNA, 1918 nt, synthetic construct
  misc_feature 1..1918: note = mRNA product Design a-3 comprising derived and/or modified sequence from HRSV(A2)__F-del_DSCav1_mut2 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2769 - RNA, 1918 nt, synthetic construct
  misc_feature 1..1918: note = mRNA product Design a-3 comprising derived and/or modified sequence from HRSV(A2)__F-del_DSCav1_mut2 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2770 - RNA, 1918 nt, synthetic construct
  misc_feature 1..1918: note = mRNA product Design a-3 comprising derived and/or modified sequence from HRSV(A2)__F-del_DSCav1_mut2 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2771 - RNA, 1918 nt, synthetic construct
  misc_feature 1..1918: note = mRNA product Design a-3 comprising derived and/or modified sequence from HRSV(A2)__F-del_DSCav1_mut2 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2772 - RNA, 1918 nt, synthetic construct
  misc_feature 1..1918: note = mRNA product Design a-3 comprising derived and/or modified sequence from HRSV(A2)__F-del_DSCav1_mut2 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2773 - RNA, 1918 nt, synthetic construct
  misc_feature 1..1918: note = mRNA product Design a-3 comprising derived and/or modified sequence from HRSV(A2)__F-del_DSCav1_mut2 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2774 - RNA, 1918 nt, synthetic construct
  misc_feature 1..1918: note = mRNA product Design a-3 comprising derived and/or modified sequence from HRSV(A2)__F-del_DSCav1_mut2 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2775 - RNA, 1918 nt, synthetic construct
  misc_feature 1..1918: note = mRNA product Design a-3 comprising derived and/or modified sequence from HRSV(A2)__F-del_DSCav1_mut2 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2776 - RNA, 1867 nt, synthetic construct
  misc_feature 1..1867: note = mRNA product Design a-4 comprising derived and/or modified sequence from HRSV(A2)__F-del_DSCav1_mut2 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2777 - RNA, 1867 nt, synthetic construct
  misc_feature 1..1867: note = mRNA product Design a-4 comprising derived and/or modified sequence from HRSV(A2)__F-del_DSCav1_mut2 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2778 - RNA, 1867 nt, synthetic construct
  misc_feature 1..1867: note = mRNA product Design a-4 comprising derived and/or modified sequence from HRSV(A2)__F-del_DSCav1_mut2 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2779 - RNA, 1867 nt, synthetic construct
  misc_feature 1..1867: note = mRNA product Design a-4 comprising derived and/or modified sequence from HRSV(A2)__F-del_DSCav1_mut2 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2780 - RNA, 1867 nt, synthetic construct
  misc_feature 1..1867: note = mRNA product Design a-4 comprising derived and/or modified sequence from HRSV(A2)__F-del_DSCav1_mut2 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2781 - RNA, 1867 nt, synthetic construct
  misc_feature 1..1867: note = mRNA product Design a-4 comprising derived and/or modified sequence from HRSV(A2)__F-del_DSCav1_mut2 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2782 - RNA, 1867 nt, synthetic construct
  misc_feature 1..1867: note = mRNA product Design a-4 comprising derived and/or modified sequence from HRSV(A2)__F-del_DSCav1_mut2 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2783 - RNA, 1867 nt, synthetic construct
  misc_feature 1..1867: note = mRNA product Design a-4 comprising derived and/or modified sequence from HRSV(A2)__F-del_DSCav1_mut2 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2784 - RNA, 1813 nt, synthetic construct
  misc_feature 1..1813: note = mRNA product Design a-5 comprising derived and/or modified sequence from HRSV(A2)__F-del_DSCav1_mut2 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2785 - RNA, 1813 nt, synthetic construct
  misc_feature 1..1813: note = mRNA product Design a-5 comprising derived and/or modified sequence from HRSV(A2)__F-del_DSCav1_mut2 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2786 - RNA, 1813 nt, synthetic construct
  misc_feature 1..1813: note = mRNA product Design a-5 comprising derived and/or modified sequence from HRSV(A2)__F-del_DSCav1_mut2 (opt2)
  source 1..1813: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2787 - RNA, 1813 nt, synthetic construct
  misc_feature 1..1813: note = mRNA product Design a-5 comprising derived and/or modified sequence from HRSV(A2)__F-del_DSCav1_mut2 (opt3)
  source 1..1813: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2788 - RNA, 1813 nt, synthetic construct
  misc_feature 1..1813: note = mRNA product Design a-5 comprising derived and/or modified sequence from HRSV(A2)__F-del_DSCav1_mut2 (opt4)
  source 1..1813: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2789 - RNA, 1813 nt, synthetic construct
  misc_feature 1..1813: note = mRNA product Design a-5 comprising derived and/or modified sequence from HRSV(A2)__F-del_DSCav1_mut2 (opt5)
  source 1..1813: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2790 - RNA, 1813 nt, synthetic construct
  misc_feature 1..1813: note = mRNA product Design a-5 comprising derived and/or modified sequence from HRSV(A2)__F-del_DSCav1_mut2 (opt6)
  source 1..1813: mol_type = other RNA
gggagactttcccattctgtagcagaatttggtgttgcctgtggtcttggtcccgcggagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2791 - RNA, 1813 nt, synthetic construct
  misc_feature 1..1813: note = mRNA product Design a-5 comprising derived and/or modified sequence from HRSV(A2)__F-del_DSCav1_mut2 (opt11)
  source 1..1813: mol_type = other RNA
gggagactttcccattctgtagcagaatttggtgttgcctgtggtcttggtcccgcggagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2792 - RNA, 1994 nt, synthetic construct
  misc_feature 1..1994: note = mRNA product Design b-1 comprising derived and/or modified sequence from HRSV(A2)__F-del_DSCav1_mut2 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2793 - RNA, 1994 nt, synthetic construct
  misc_feature 1..1994: note = mRNA product Design b-1 comprising derived and/or modified sequence from HRSV(A2)__F-del_DSCav1_mut2 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2794 - RNA, 1994 nt, synthetic construct
  misc_feature 1..1994: note = mRNA product Design b-1 comprising derived and/or modified sequence from HRSV(A2)__F-del_DSCav1_mut2 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2795 - RNA, 1994 nt, synthetic construct
  misc_feature 1..1994: note = mRNA product Design b-1 comprising derived and/or modified sequence from HRSV(A2)__F-del_DSCav1_mut2 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2796 - RNA, 1994 nt, synthetic construct
  misc_feature 1..1994: note = mRNA product Design b-1 comprising derived and/or modified sequence from HRSV(A2)__F-del_DSCav1_mut2 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2797 - RNA, 1994 nt, synthetic construct
  misc_feature 1..1994: note = mRNA product Design b-1 comprising derived and/or modified sequence from HRSV(A2)__F-del_DSCav1_mut2 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2798 - RNA, 1994 nt, synthetic construct
  misc_feature 1..1994: note = mRNA product Design b-1 comprising derived and/or modified sequence from HRSV(A2)__F-del_DSCav1_mut2 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2799 - RNA, 1994 nt, synthetic construct
  misc_feature 1..1994: note = mRNA product Design b-1 comprising derived and/or modified sequence from HRSV(A2)__F-del_DSCav1_mut2 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2800 - RNA, 1814 nt, synthetic construct
  misc_feature 1..1814: note = mRNA product Design b-2 comprising derived and/or modified sequence from HRSV(A2)__F-del_DSCav1_mut2 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2801 - RNA, 1814 nt, synthetic construct
  misc_feature 1..1814: note = mRNA product Design b-2 comprising derived and/or modified sequence from HRSV(A2)__F-del_DSCav1_mut2 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2802 - RNA, 1814 nt, synthetic construct
  misc_feature 1..1814: note = mRNA product Design b-2 comprising derived and/or modified sequence from HRSV(A2)__F-del_DSCav1_mut2 (opt2)
  source 1..1814: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2803 - RNA, 1814 nt, synthetic construct
  misc_feature 1..1814: note = mRNA product Design b-2 comprising derived and/or modified sequence from HRSV(A2)__F-del_DSCav1_mut2 (opt3)
  source 1..1814: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2804 - RNA, 1814 nt, synthetic construct
  misc_feature 1..1814: note = mRNA product Design b-2 comprising derived and/or modified sequence from HRSV(A2)__F-del_DSCav1_mut2 (opt4)
  source 1..1814: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2805 - RNA, 1814 nt, synthetic construct
  misc_feature 1..1814: note = mRNA product Design b-2 comprising derived and/or modified sequence from HRSV(A2)__F-del_DSCav1_mut2 (opt5)
  source 1..1814: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2806 - RNA, 1814 nt, synthetic construct
  misc_feature 1..1814: note = mRNA product Design b-2 comprising derived and/or modified sequence from HRSV(A2)__F-del_DSCav1_mut2 (opt6)
  source 1..1814: mol_type = other RNA
gggagagcctctgctggagtccggggagtggcgttggctgctagagcgaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2807 - RNA, 1814 nt, synthetic construct
  misc_feature 1..1814: note = mRNA product Design b-2 comprising derived and/or modified sequence from HRSV(A2)__F-del_DSCav1_mut2 (opt11)
  source 1..1814: mol_type = other RNA
gggagagcctctgctggagtccggggagtggcgttggctgctagagcgaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2808 - RNA, 1834 nt, synthetic construct
  misc_feature 1..1834: note = mRNA product Design b-3 comprising derived and/or modified sequence from HRSV(A2)__F-del_DSCav1_mut2 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2809 - RNA, 1834 nt, synthetic construct
  misc_feature 1..1834: note = mRNA product Design b-3 comprising derived and/or modified sequence from HRSV(A2)__F-del_DSCav1_mut2 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2810 - RNA, 1834 nt, synthetic construct
  misc_feature 1..1834: note = mRNA product Design b-3 comprising derived and/or modified sequence from HRSV(A2)__F-del_DSCav1_mut2 (opt2)
  source 1..1834: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2811 - RNA, 1834 nt, synthetic construct
  misc_feature 1..1834: note = mRNA product Design b-3 comprising derived and/or modified sequence from HRSV(A2)__F-del_DSCav1_mut2 (opt3)
  source 1..1834: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2812 - RNA, 1834 nt, synthetic construct
  misc_feature 1..1834: note = mRNA product Design b-3 comprising derived and/or modified sequence from HRSV(A2)__F-del_DSCav1_mut2 (opt4)
  source 1..1834: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2813 - RNA, 1834 nt, synthetic construct
  misc_feature 1..1834: note = mRNA product Design b-3 comprising derived and/or modified sequence from HRSV(A2)__F-del_DSCav1_mut2 (opt5)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2814 - RNA, 1834 nt, synthetic construct
  misc_feature 1..1834: note = mRNA product Design b-3 comprising derived and/or modified sequence from HRSV(A2)__F-del_DSCav1_mut2 (opt6)
  source 1..1834: mol_type = other RNA
gggagagtcccgcagtcggcgtccagcggctctgcttgttcgtgtgtgtgtcgttgcaggccttattcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2815 - RNA, 1834 nt, synthetic construct
  misc_feature 1..1834: note = mRNA product Design b-3 comprising derived and/or modified sequence from HRSV(A2)__F-del_DSCav1_mut2 (opt11)
  source 1..1834: mol_type = other RNA
gggagagtcccgcagtcggcgtccagcggctctgcttgttcgtgtgtgtgtcgttgcaggccttattcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2816 - RNA, 1885 nt, synthetic construct
  misc_feature 1..1885: note = mRNA product Design b-4 comprising derived and/or modified sequence from HRSV(A2)__F-del_DSCav1_mut2 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2817 - RNA, 1885 nt, synthetic construct
  misc_feature 1..1885: note = mRNA product Design b-4 comprising derived and/or modified sequence from HRSV(A2)__F-del_DSCav1_mut2 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2818 - RNA, 1885 nt, synthetic construct
  misc_feature 1..1885: note = mRNA product Design b-4 comprising derived and/or modified sequence from HRSV(A2)__F-del_DSCav1_mut2 (opt2)
  source 1..1885: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2819 - RNA, 1885 nt, synthetic construct
  misc_feature 1..1885: note = mRNA product Design b-4 comprising derived and/or modified sequence from HRSV(A2)__F-del_DSCav1_mut2 (opt3)
  source 1..1885: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2820 - RNA, 1885 nt, synthetic construct
  misc_feature 1..1885: note = mRNA product Design b-4 comprising derived and/or modified sequence from HRSV(A2)__F-del_DSCav1_mut2 (opt4)
  source 1..1885: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2821 - RNA, 1885 nt, synthetic construct
  misc_feature 1..1885: note = mRNA product Design b-4 comprising derived and/or modified sequence from HRSV(A2)__F-del_DSCav1_mut2 (opt5)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2822 - RNA, 1885 nt, synthetic construct
  misc_feature 1..1885: note = mRNA product Design b-4 comprising derived and/or modified sequence from HRSV(A2)__F-del_DSCav1_mut2 (opt6)
  source 1..1885: mol_type = other RNA
gggagagtcccgcagtcggcgtccagcggctctgcttgttcgtgtgtgtgtcgttgcaggccttattcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2823 - RNA, 1885 nt, synthetic construct
  misc_feature 1..1885: note = mRNA product Design b-4 comprising derived and/or modified sequence from HRSV(A2)__F-del_DSCav1_mut2 (opt11)
  source 1..1885: mol_type = other RNA
gggagagtcccgcagtcggcgtccagcggctctgcttgttcgtgtgtgtgtcgttgcaggccttattcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2824 - RNA, 1947 nt, synthetic construct
  misc_feature 1..1947: note = mRNA product Design b-5 comprising derived and/or modified sequence from HRSV(A2)__F-del_DSCav1_mut2 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2825 - RNA, 1947 nt, synthetic construct
  misc_feature 1..1947: note = mRNA product Design b-5 comprising derived and/or modified sequence from HRSV(A2)__F-del_DSCav1_mut2 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2826 - RNA, 1947 nt, synthetic construct
  misc_feature 1..1947: note = mRNA product Design b-5 comprising derived and/or modified sequence from HRSV(A2)__F-del_DSCav1_mut2 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2827 - RNA, 1947 nt, synthetic construct
  misc_feature 1..1947: note = mRNA product Design b-5 comprising derived and/or modified sequence from HRSV(A2)__F-del_DSCav1_mut2 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2828 - RNA, 1947 nt, synthetic construct
  misc_feature 1..1947: note = mRNA product Design b-5 comprising derived and/or modified sequence from HRSV(A2)__F-del_DSCav1_mut2 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2829 - RNA, 1947 nt, synthetic construct
  misc_feature 1..1947: note = mRNA product Design b-5 comprising derived and/or modified sequence from HRSV(A2)__F-del_DSCav1_mut2 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2830 - RNA, 1947 nt, synthetic construct
  misc_feature 1..1947: note = mRNA product Design b-5 comprising derived and/or modified sequence from HRSV(A2)__F-del_DSCav1_mut2 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2831 - RNA, 1947 nt, synthetic construct
  misc_feature 1..1947: note = mRNA product Design b-5 comprising derived and/or modified sequence from HRSV(A2)__F-del_DSCav1_mut2 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2832 - RNA, 1853 nt, synthetic construct
  misc_feature 1..1853: note = mRNA product Design c-1 comprising derived and/or modified sequence from HRSV(A2)__F-del_DSCav1_mut2 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2833 - RNA, 1853 nt, synthetic construct
  misc_feature 1..1853: note = mRNA product Design c-1 comprising derived and/or modified sequence from HRSV(A2)__F-del_DSCav1_mut2 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2834 - RNA, 1853 nt, synthetic construct
  misc_feature 1..1853: note = mRNA product Design c-1 comprising derived and/or modified sequence from HRSV(A2)__F-del_DSCav1_mut2 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2835 - RNA, 1853 nt, synthetic construct
  misc_feature 1..1853: note = mRNA product Design c-1 comprising derived and/or modified sequence from HRSV(A2)__F-del_DSCav1_mut2 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2836 - RNA, 1853 nt, synthetic construct
  misc_feature 1..1853: note = mRNA product Design c-1 comprising derived and/or modified sequence from HRSV(A2)__F-del_DSCav1_mut2 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2837 - RNA, 1853 nt, synthetic construct
  misc_feature 1..1853: note = mRNA product Design c-1 comprising derived and/or modified sequence from HRSV(A2)__F-del_DSCav1_mut2 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2838 - RNA, 1853 nt, synthetic construct
  misc_feature 1..1853: note = mRNA product Design c-1 comprising derived and/or modified sequence from HRSV(A2)__F-del_DSCav1_mut2 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2839 - RNA, 1853 nt, synthetic construct
  misc_feature 1..1853: note = mRNA product Design c-1 comprising derived and/or modified sequence from HRSV(A2)__F-del_DSCav1_mut2 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2840 - RNA, 1943 nt, synthetic construct
  misc_feature 1..1943: note = mRNA product Design c-2 comprising derived and/or modified sequence from HRSV(A2)__F-del_DSCav1_mut2 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2841 - RNA, 1943 nt, synthetic construct
  misc_feature 1..1943: note = mRNA product Design c-2 comprising derived and/or modified sequence from HRSV(A2)__F-del_DSCav1_mut2 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2842 - RNA, 1943 nt, synthetic construct
  misc_feature 1..1943: note = mRNA product Design c-2 comprising derived and/or modified sequence from HRSV(A2)__F-del_DSCav1_mut2 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2843 - RNA, 1943 nt, synthetic construct
  misc_feature 1..1943: note = mRNA product Design c-2 comprising derived and/or modified sequence from HRSV(A2)__F-del_DSCav1_mut2 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2844 - RNA, 1943 nt, synthetic construct
  misc_feature 1..1943: note = mRNA product Design c-2 comprising derived and/or modified sequence from HRSV(A2)__F-del_DSCav1_mut2 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2845 - RNA, 1943 nt, synthetic construct
  misc_feature 1..1943: note = mRNA product Design c-2 comprising derived and/or modified sequence from HRSV(A2)__F-del_DSCav1_mut2 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2846 - RNA, 1943 nt, synthetic construct
  misc_feature 1..1943: note = mRNA product Design c-2 comprising derived and/or modified sequence from HRSV(A2)__F-del_DSCav1_mut2 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2847 - RNA, 1943 nt, synthetic construct
  misc_feature 1..1943: note = mRNA product Design c-2 comprising derived and/or modified sequence from HRSV(A2)__F-del_DSCav1_mut2 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2848 - RNA, 1920 nt, synthetic construct
  misc_feature 1..1920: note = mRNA product Design c-3 comprising derived and/or modified sequence from HRSV(A2)__F-del_DSCav1_mut2 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2849 - RNA, 1920 nt, synthetic construct
  misc_feature 1..1920: note = mRNA product Design c-3 comprising derived and/or modified sequence from HRSV(A2)__F-del_DSCav1_mut2 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2850 - RNA, 1920 nt, synthetic construct
  misc_feature 1..1920: note = mRNA product Design c-3 comprising derived and/or modified sequence from HRSV(A2)__F-del_DSCav1_mut2 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2851 - RNA, 1920 nt, synthetic construct
  misc_feature 1..1920: note = mRNA product Design c-3 comprising derived and/or modified sequence from HRSV(A2)__F-del_DSCav1_mut2 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2852 - RNA, 1920 nt, synthetic construct
  misc_feature 1..1920: note = mRNA product Design c-3 comprising derived and/or modified sequence from HRSV(A2)__F-del_DSCav1_mut2 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2853 - RNA, 1920 nt, synthetic construct
  misc_feature 1..1920: note = mRNA product Design c-3 comprising derived and/or modified sequence from HRSV(A2)__F-del_DSCav1_mut2 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2854 - RNA, 1920 nt, synthetic construct
  misc_feature 1..1920: note = mRNA product Design c-3 comprising derived and/or modified sequence from HRSV(A2)__F-del_DSCav1_mut2 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2855 - RNA, 1920 nt, synthetic construct
  misc_feature 1..1920: note = mRNA product Design c-3 comprising derived and/or modified sequence from HRSV(A2)__F-del_DSCav1_mut2 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2856 - RNA, 1916 nt, synthetic construct
  misc_feature 1..1916: note = mRNA product Design c-4 comprising derived and/or modified sequence from HRSV(A2)__F-del_DSCav1_mut2 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2857 - RNA, 1916 nt, synthetic construct
  misc_feature 1..1916: note = mRNA product Design c-4 comprising derived and/or modified sequence from HRSV(A2)__F-del_DSCav1_mut2 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2858 - RNA, 1916 nt, synthetic construct
  misc_feature 1..1916: note = mRNA product Design c-4 comprising derived and/or modified sequence from HRSV(A2)__F-del_DSCav1_mut2 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2859 - RNA, 1916 nt, synthetic construct
  misc_feature 1..1916: note = mRNA product Design c-4 comprising derived and/or modified sequence from HRSV(A2)__F-del_DSCav1_mut2 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2860 - RNA, 1916 nt, synthetic construct
  misc_feature 1..1916: note = mRNA product Design c-4 comprising derived and/or modified sequence from HRSV(A2)__F-del_DSCav1_mut2 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2861 - RNA, 1916 nt, synthetic construct
  misc_feature 1..1916: note = mRNA product Design c-4 comprising derived and/or modified sequence from HRSV(A2)__F-del_DSCav1_mut2 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2862 - RNA, 1916 nt, synthetic construct
  misc_feature 1..1916: note = mRNA product Design c-4 comprising derived and/or modified sequence from HRSV(A2)__F-del_DSCav1_mut2 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2863 - RNA, 1916 nt, synthetic construct
  misc_feature 1..1916: note = mRNA product Design c-4 comprising derived and/or modified sequence from HRSV(A2)__F-del_DSCav1_mut2 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2864 - RNA, 1834 nt, synthetic construct
  misc_feature 1..1834: note = mRNA product Design c-5 comprising derived and/or modified sequence from HRSV(A2)__F-del_DSCav1_mut2 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2865 - RNA, 1834 nt, synthetic construct
  misc_feature 1..1834: note = mRNA product Design c-5 comprising derived and/or modified sequence from HRSV(A2)__F-del_DSCav1_mut2 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2866 - RNA, 1834 nt, synthetic construct
  misc_feature 1..1834: note = mRNA product Design c-5 comprising derived and/or modified sequence from HRSV(A2)__F-del_DSCav1_mut2 (opt2)
  source 1..1834: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2867 - RNA, 1834 nt, synthetic construct
  misc_feature 1..1834: note = mRNA product Design c-5 comprising derived and/or modified sequence from HRSV(A2)__F-del_DSCav1_mut2 (opt3)
  source 1..1834: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2868 - RNA, 1834 nt, synthetic construct
  misc_feature 1..1834: note = mRNA product Design c-5 comprising derived and/or modified sequence from HRSV(A2)__F-del_DSCav1_mut2 (opt4)
  source 1..1834: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2869 - RNA, 1834 nt, synthetic construct
  misc_feature 1..1834: note = mRNA product Design c-5 comprising derived and/or modified sequence from HRSV(A2)__F-del_DSCav1_mut2 (opt5)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2870 - RNA, 1834 nt, synthetic construct
  misc_feature 1..1834: note = mRNA product Design c-5 comprising derived and/or modified sequence from HRSV(A2)__F-del_DSCav1_mut2 (opt6)
  source 1..1834: mol_type = other RNA
gggagagcggctcggccattttgtcccagtcagtccggaggctgcggctgcagaagtaccgcctgcggagtaactgcaaagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2871 - RNA, 1834 nt, synthetic construct
  misc_feature 1..1834: note = mRNA product Design c-5 comprising derived and/or modified sequence from HRSV(A2)__F-del_DSCav1_mut2 (opt11)
  source 1..1834: mol_type = other RNA
gggagagcggctcggccattttgtcccagtcagtccggaggctgcggctgcagaagtaccgcctgcggagtaactgcaaagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2872 - RNA, 1843 nt, synthetic construct
  misc_feature 1..1843: note = mRNA product Design d-1 comprising derived and/or modified sequence from HRSV(A2)__F-del_DSCav1_mut2 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2873 - RNA, 1843 nt, synthetic construct
  misc_feature 1..1843: note = mRNA product Design d-1 comprising derived and/or modified sequence from HRSV(A2)__F-del_DSCav1_mut2 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2874 - RNA, 1843 nt, synthetic construct
  misc_feature 1..1843: note = mRNA product Design d-1 comprising derived and/or modified sequence from HRSV(A2)__F-del_DSCav1_mut2 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2875 - RNA, 1843 nt, synthetic construct
  misc_feature 1..1843: note = mRNA product Design d-1 comprising derived and/or modified sequence from HRSV(A2)__F-del_DSCav1_mut2 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2876 - RNA, 1843 nt, synthetic construct
  misc_feature 1..1843: note = mRNA product Design d-1 comprising derived and/or modified sequence from HRSV(A2)__F-del_DSCav1_mut2 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2877 - RNA, 1843 nt, synthetic construct
  misc_feature 1..1843: note = mRNA product Design d-1 comprising derived and/or modified sequence from HRSV(A2)__F-del_DSCav1_mut2 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2878 - RNA, 1843 nt, synthetic construct
  misc_feature 1..1843: note = mRNA product Design d-1 comprising derived and/or modified sequence from HRSV(A2)__F-del_DSCav1_mut2 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2879 - RNA, 1843 nt, synthetic construct
  misc_feature 1..1843: note = mRNA product Design d-1 comprising derived and/or modified sequence from HRSV(A2)__F-del_DSCav1_mut2 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2880 - RNA, 1898 nt, synthetic construct
  misc_feature 1..1898: note = mRNA product Design d-2 comprising derived and/or modified sequence from HRSV(A2)__F-del_DSCav1_mut2 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2881 - RNA, 1898 nt, synthetic construct
  misc_feature 1..1898: note = mRNA product Design d-2 comprising derived and/or modified sequence from HRSV(A2)__F-del_DSCav1_mut2 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2882 - RNA, 1898 nt, synthetic construct
  misc_feature 1..1898: note = mRNA product Design d-2 comprising derived and/or modified sequence from HRSV(A2)__F-del_DSCav1_mut2 (opt2)
  source 1..1898: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2883 - RNA, 1898 nt, synthetic construct
  misc_feature 1..1898: note = mRNA product Design d-2 comprising derived and/or modified sequence from HRSV(A2)__F-del_DSCav1_mut2 (opt3)
  source 1..1898: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2884 - RNA, 1898 nt, synthetic construct
  misc_feature 1..1898: note = mRNA product Design d-2 comprising derived and/or modified sequence from HRSV(A2)__F-del_DSCav1_mut2 (opt4)
  source 1..1898: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2885 - RNA, 1898 nt, synthetic construct
  misc_feature 1..1898: note = mRNA product Design d-2 comprising derived and/or modified sequence from HRSV(A2)__F-del_DSCav1_mut2 (opt5)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2886 - RNA, 1898 nt, synthetic construct
  misc_feature 1..1898: note = mRNA product Design d-2 comprising derived and/or modified sequence from HRSV(A2)__F-del_DSCav1_mut2 (opt6)
  source 1..1898: mol_type = other RNA
gggagagcggctcggccattttgtcccagtcagtccggaggctgcggctgcagaagtaccgcctgcggagtaactgcaaagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2887 - RNA, 1898 nt, synthetic construct
  misc_feature 1..1898: note = mRNA product Design d-2 comprising derived and/or modified sequence from HRSV(A2)__F-del_DSCav1_mut2 (opt11)
  source 1..1898: mol_type = other RNA
gggagagcggctcggccattttgtcccagtcagtccggaggctgcggctgcagaagtaccgcctgcggagtaactgcaaagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2888 - RNA, 2214 nt, synthetic construct
  misc_feature 1..2214: note = mRNA product Design d-3 comprising derived and/or modified sequence from HRSV(A2)__F-del_DSCav1_mut2 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2889 - RNA, 2214 nt, synthetic construct
  misc_feature 1..2214: note = mRNA product Design d-3 comprising derived and/or modified sequence from HRSV(A2)__F-del_DSCav1_mut2 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2890 - RNA, 2214 nt, synthetic construct
  misc_feature 1..2214: note = mRNA product Design d-3 comprising derived and/or modified sequence from HRSV(A2)__F-del_DSCav1_mut2 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2891 - RNA, 2214 nt, synthetic construct
  misc_feature 1..2214: note = mRNA product Design d-3 comprising derived and/or modified sequence from HRSV(A2)__F-del_DSCav1_mut2 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2892 - RNA, 2214 nt, synthetic construct
  misc_feature 1..2214: note = mRNA product Design d-3 comprising derived and/or modified sequence from HRSV(A2)__F-del_DSCav1_mut2 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2893 - RNA, 2214 nt, synthetic construct
  misc_feature 1..2214: note = mRNA product Design d-3 comprising derived and/or modified sequence from HRSV(A2)__F-del_DSCav1_mut2 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2894 - RNA, 2214 nt, synthetic construct
  misc_feature 1..2214: note = mRNA product Design d-3 comprising derived and/or modified sequence from HRSV(A2)__F-del_DSCav1_mut2 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2895 - RNA, 2214 nt, synthetic construct
  misc_feature 1..2214: note = mRNA product Design d-3 comprising derived and/or modified sequence from HRSV(A2)__F-del_DSCav1_mut2 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2896 - RNA, 1897 nt, synthetic construct
  misc_feature 1..1897: note = mRNA product Design d-4 comprising derived and/or modified sequence from HRSV(A2)__F-del_DSCav1_mut2 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2897 - RNA, 1897 nt, synthetic construct
  misc_feature 1..1897: note = mRNA product Design d-4 comprising derived and/or modified sequence from HRSV(A2)__F-del_DSCav1_mut2 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2898 - RNA, 1897 nt, synthetic construct
  misc_feature 1..1897: note = mRNA product Design d-4 comprising derived and/or modified sequence from HRSV(A2)__F-del_DSCav1_mut2 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2899 - RNA, 1897 nt, synthetic construct
  misc_feature 1..1897: note = mRNA product Design d-4 comprising derived and/or modified sequence from HRSV(A2)__F-del_DSCav1_mut2 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2900 - RNA, 1897 nt, synthetic construct
  misc_feature 1..1897: note = mRNA product Design d-4 comprising derived and/or modified sequence from HRSV(A2)__F-del_DSCav1_mut2 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2901 - RNA, 1897 nt, synthetic construct
  misc_feature 1..1897: note = mRNA product Design d-4 comprising derived and/or modified sequence from HRSV(A2)__F-del_DSCav1_mut2 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2902 - RNA, 1897 nt, synthetic construct
  misc_feature 1..1897: note = mRNA product Design d-4 comprising derived and/or modified sequence from HRSV(A2)__F-del_DSCav1_mut2 (opt6)
  source 1..1897: mol_type = other RNA
gggagagtcccgcagtcggcgtccagcggctctgcttgttcgtgtgtgtgtcgttgcaggccttattcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2903 - RNA, 1897 nt, synthetic construct
  misc_feature 1..1897: note = mRNA product Design d-4 comprising derived and/or modified sequence from HRSV(A2)__F-del_DSCav1_mut2 (opt11)
  source 1..1897: mol_type = other RNA
gggagagtcccgcagtcggcgtccagcggctctgcttgttcgtgtgtgtgtcgttgcaggccttattcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2904 - RNA, 1994 nt, synthetic construct
  misc_feature 1..1994: note = mRNA product Design d-5 comprising derived and/or modified sequence from HRSV(A2)__F-del_DSCav1_mut2 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2905 - RNA, 1994 nt, synthetic construct
  misc_feature 1..1994: note = mRNA product Design d-5 comprising derived and/or modified sequence from HRSV(A2)__F-del_DSCav1_mut2 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2906 - RNA, 1994 nt, synthetic construct
  misc_feature 1..1994: note = mRNA product Design d-5 comprising derived and/or modified sequence from HRSV(A2)__F-del_DSCav1_mut2 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2907 - RNA, 1994 nt, synthetic construct
  misc_feature 1..1994: note = mRNA product Design d-5 comprising derived and/or modified sequence from HRSV(A2)__F-del_DSCav1_mut2 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2908 - RNA, 1994 nt, synthetic construct
  misc_feature 1..1994: note = mRNA product Design d-5 comprising derived and/or modified sequence from HRSV(A2)__F-del_DSCav1_mut2 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2909 - RNA, 1994 nt, synthetic construct
  misc_feature 1..1994: note = mRNA product Design d-5 comprising derived and/or modified sequence from HRSV(A2)__F-del_DSCav1_mut2 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2910 - RNA, 1994 nt, synthetic construct
  misc_feature 1..1994: note = mRNA product Design d-5 comprising derived and/or modified sequence from HRSV(A2)__F-del_DSCav1_mut2 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2911 - RNA, 1994 nt, synthetic construct
  misc_feature 1..1994: note = mRNA product Design d-5 comprising derived and/or modified sequence from HRSV(A2)__F-del_DSCav1_mut2 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2912 - RNA, 1874 nt, synthetic construct
  misc_feature 1..1874: note = mRNA product Design e-1 comprising derived and/or modified sequence from HRSV(A2)__F-del_DSCav1_mut2 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2913 - RNA, 1874 nt, synthetic construct
  misc_feature 1..1874: note = mRNA product Design e-1 comprising derived and/or modified sequence from HRSV(A2)__F-del_DSCav1_mut2 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2914 - RNA, 1874 nt, synthetic construct
  misc_feature 1..1874: note = mRNA product Design e-1 comprising derived and/or modified sequence from HRSV(A2)__F-del_DSCav1_mut2 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2915 - RNA, 1874 nt, synthetic construct
  misc_feature 1..1874: note = mRNA product Design e-1 comprising derived and/or modified sequence from HRSV(A2)__F-del_DSCav1_mut2 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2916 - RNA, 1874 nt, synthetic construct
  misc_feature 1..1874: note = mRNA product Design e-1 comprising derived and/or modified sequence from HRSV(A2)__F-del_DSCav1_mut2 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2917 - RNA, 1874 nt, synthetic construct
  misc_feature 1..1874: note = mRNA product Design e-1 comprising derived and/or modified sequence from HRSV(A2)__F-del_DSCav1_mut2 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2918 - RNA, 1874 nt, synthetic construct
  misc_feature 1..1874: note = mRNA product Design e-1 comprising derived and/or modified sequence from HRSV(A2)__F-del_DSCav1_mut2 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2919 - RNA, 1874 nt, synthetic construct
  misc_feature 1..1874: note = mRNA product Design e-1 comprising derived and/or modified sequence from HRSV(A2)__F-del_DSCav1_mut2 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2920 - RNA, 1856 nt, synthetic construct
  misc_feature 1..1856: note = mRNA product Design e-2 comprising derived and/or modified sequence from HRSV(A2)__F-del_DSCav1_mut2 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2921 - RNA, 1856 nt, synthetic construct
  misc_feature 1..1856: note = mRNA product Design e-2 comprising derived and/or modified sequence from HRSV(A2)__F-del_DSCav1_mut2 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2922 - RNA, 1856 nt, synthetic construct
  misc_feature 1..1856: note = mRNA product Design e-2 comprising derived and/or modified sequence from HRSV(A2)__F-del_DSCav1_mut2 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2923 - RNA, 1856 nt, synthetic construct
  misc_feature 1..1856: note = mRNA product Design e-2 comprising derived and/or modified sequence from HRSV(A2)__F-del_DSCav1_mut2 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2924 - RNA, 1856 nt, synthetic construct
  misc_feature 1..1856: note = mRNA product Design e-2 comprising derived and/or modified sequence from HRSV(A2)__F-del_DSCav1_mut2 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2925 - RNA, 1856 nt, synthetic construct
  misc_feature 1..1856: note = mRNA product Design e-2 comprising derived and/or modified sequence from HRSV(A2)__F-del_DSCav1_mut2 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2926 - RNA, 1856 nt, synthetic construct
  misc_feature 1..1856: note = mRNA product Design e-2 comprising derived and/or modified sequence from HRSV(A2)__F-del_DSCav1_mut2 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2927 - RNA, 1856 nt, synthetic construct
  misc_feature 1..1856: note = mRNA product Design e-2 comprising derived and/or modified sequence from HRSV(A2)__F-del_DSCav1_mut2 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2928 - RNA, 1826 nt, synthetic construct
  misc_feature 1..1826: note = mRNA product Design e-3 comprising derived and/or modified sequence from HRSV(A2)__F-del_DSCav1_mut2 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2929 - RNA, 1826 nt, synthetic construct
  misc_feature 1..1826: note = mRNA product Design e-3 comprising derived and/or modified sequence from HRSV(A2)__F-del_DSCav1_mut2 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2930 - RNA, 1826 nt, synthetic construct
  misc_feature 1..1826: note = mRNA product Design e-3 comprising derived and/or modified sequence from HRSV(A2)__F-del_DSCav1_mut2 (opt2)
  source 1..1826: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2931 - RNA, 1826 nt, synthetic construct
  misc_feature 1..1826: note = mRNA product Design e-3 comprising derived and/or modified sequence from HRSV(A2)__F-del_DSCav1_mut2 (opt3)
  source 1..1826: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2932 - RNA, 1826 nt, synthetic construct
  misc_feature 1..1826: note = mRNA product Design e-3 comprising derived and/or modified sequence from HRSV(A2)__F-del_DSCav1_mut2 (opt4)
  source 1..1826: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2933 - RNA, 1826 nt, synthetic construct
  misc_feature 1..1826: note = mRNA product Design e-3 comprising derived and/or modified sequence from HRSV(A2)__F-del_DSCav1_mut2 (opt5)
  source 1..1826: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2934 - RNA, 1826 nt, synthetic construct
  misc_feature 1..1826: note = mRNA product Design e-3 comprising derived and/or modified sequence from HRSV(A2)__F-del_DSCav1_mut2 (opt6)
  source 1..1826: mol_type = other RNA
gggagactttcccattctgtagcagaatttggtgttgcctgtggtcttggtcccgcggagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2935 - RNA, 1826 nt, synthetic construct
  misc_feature 1..1826: note = mRNA product Design e-3 comprising derived and/or modified sequence from HRSV(A2)__F-del_DSCav1_mut2 (opt11)
  source 1..1826: mol_type = other RNA
gggagactttcccattctgtagcagaatttggtgttgcctgtggtcttggtcccgcggagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2936 - RNA, 1880 nt, synthetic construct
  misc_feature 1..1880: note = mRNA product Design e-4 comprising derived and/or modified sequence from HRSV(A2)__F-del_DSCav1_mut2 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2937 - RNA, 1880 nt, synthetic construct
  misc_feature 1..1880: note = mRNA product Design e-4 comprising derived and/or modified sequence from HRSV(A2)__F-del_DSCav1_mut2 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2938 - RNA, 1880 nt, synthetic construct
  misc_feature 1..1880: note = mRNA product Design e-4 comprising derived and/or modified sequence from HRSV(A2)__F-del_DSCav1_mut2 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2939 - RNA, 1880 nt, synthetic construct
  misc_feature 1..1880: note = mRNA product Design e-4 comprising derived and/or modified sequence from HRSV(A2)__F-del_DSCav1_mut2 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2940 - RNA, 1880 nt, synthetic construct
  misc_feature 1..1880: note = mRNA product Design e-4 comprising derived and/or modified sequence from HRSV(A2)__F-del_DSCav1_mut2 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2941 - RNA, 1880 nt, synthetic construct
  misc_feature 1..1880: note = mRNA product Design e-4 comprising derived and/or modified sequence from HRSV(A2)__F-del_DSCav1_mut2 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2942 - RNA, 1880 nt, synthetic construct
  misc_feature 1..1880: note = mRNA product Design e-4 comprising derived and/or modified sequence from HRSV(A2)__F-del_DSCav1_mut2 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2943 - RNA, 1880 nt, synthetic construct
  misc_feature 1..1880: note = mRNA product Design e-4 comprising derived and/or modified sequence from HRSV(A2)__F-del_DSCav1_mut2 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2944 - RNA, 1847 nt, synthetic construct
  misc_feature 1..1847: note = mRNA product Design e-5 comprising derived and/or modified sequence from HRSV(A2)__F-del_DSCav1_mut2 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2945 - RNA, 1847 nt, synthetic construct
  misc_feature 1..1847: note = mRNA product Design e-5 comprising derived and/or modified sequence from HRSV(A2)__F-del_DSCav1_mut2 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2946 - RNA, 1847 nt, synthetic construct
  misc_feature 1..1847: note = mRNA product Design e-5 comprising derived and/or modified sequence from HRSV(A2)__F-del_DSCav1_mut2 (opt2)
  source 1..1847: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2947 - RNA, 1847 nt, synthetic construct
  misc_feature 1..1847: note = mRNA product Design e-5 comprising derived and/or modified sequence from HRSV(A2)__F-del_DSCav1_mut2 (opt3)
  source 1..1847: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2948 - RNA, 1847 nt, synthetic construct
  misc_feature 1..1847: note = mRNA product Design e-5 comprising derived and/or modified sequence from HRSV(A2)__F-del_DSCav1_mut2 (opt4)
  source 1..1847: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2949 - RNA, 1847 nt, synthetic construct
  misc_feature 1..1847: note = mRNA product Design e-5 comprising derived and/or modified sequence from HRSV(A2)__F-del_DSCav1_mut2 (opt5)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2950 - RNA, 1847 nt, synthetic construct
  misc_feature 1..1847: note = mRNA product Design e-5 comprising derived and/or modified sequence from HRSV(A2)__F-del_DSCav1_mut2 (opt6)
  source 1..1847: mol_type = other RNA
gggagagcggctcggccattttgtcccagtcagtccggaggctgcggctgcagaagtaccgcctgcggagtaactgcaaagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2951 - RNA, 1847 nt, synthetic construct
  misc_feature 1..1847: note = mRNA product Design e-5 comprising derived and/or modified sequence from HRSV(A2)__F-del_DSCav1_mut2 (opt11)
  source 1..1847: mol_type = other RNA
gggagagcggctcggccattttgtcccagtcagtccggaggctgcggctgcagaagtaccgcctgcggagtaactgcaaagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2952 - RNA, 1914 nt, synthetic construct
  misc_feature 1..1914: note = mRNA product Design e-6 comprising derived and/or modified sequence from HRSV(A2)__F-del_DSCav1_mut2 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2953 - RNA, 1914 nt, synthetic construct
  misc_feature 1..1914: note = mRNA product Design e-6 comprising derived and/or modified sequence from HRSV(A2)__F-del_DSCav1_mut2 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2954 - RNA, 1914 nt, synthetic construct
  misc_feature 1..1914: note = mRNA product Design e-6 comprising derived and/or modified sequence from HRSV(A2)__F-del_DSCav1_mut2 (opt2)
  source 1..1914: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2955 - RNA, 1914 nt, synthetic construct
  misc_feature 1..1914: note = mRNA product Design e-6 comprising derived and/or modified sequence from HRSV(A2)__F-del_DSCav1_mut2 (opt3)
  source 1..1914: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2956 - RNA, 1914 nt, synthetic construct
  misc_feature 1..1914: note = mRNA product Design e-6 comprising derived and/or modified sequence from HRSV(A2)__F-del_DSCav1_mut2 (opt4)
  source 1..1914: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2957 - RNA, 1914 nt, synthetic construct
  misc_feature 1..1914: note = mRNA product Design e-6 comprising derived and/or modified sequence from HRSV(A2)__F-del_DSCav1_mut2 (opt5)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2958 - RNA, 1914 nt, synthetic construct
  misc_feature 1..1914: note = mRNA product Design e-6 comprising derived and/or modified sequence from HRSV(A2)__F-del_DSCav1_mut2 (opt6)
  source 1..1914: mol_type = other RNA
gggagagcggctcggccattttgtcccagtcagtccggaggctgcggctgcagaagtaccgcctgcggagtaactgcaaagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2959 - RNA, 1914 nt, synthetic construct
  misc_feature 1..1914: note = mRNA product Design e-6 comprising derived and/or modified sequence from HRSV(A2)__F-del_DSCav1_mut2 (opt11)
  source 1..1914: mol_type = other RNA
gggagagcggctcggccattttgtcccagtcagtccggaggctgcggctgcagaagtaccgcctgcggagtaactgcaaagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2960 - RNA, 2130 nt, synthetic construct
  misc_feature 1..2130: note = mRNA product Design f-1 comprising derived and/or modified sequence from HRSV(A2)__F-del_DSCav1_mut2 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2961 - RNA, 2130 nt, synthetic construct
  misc_feature 1..2130: note = mRNA product Design f-1 comprising derived and/or modified sequence from HRSV(A2)__F-del_DSCav1_mut2 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2962 - RNA, 2130 nt, synthetic construct
  misc_feature 1..2130: note = mRNA product Design f-1 comprising derived and/or modified sequence from HRSV(A2)__F-del_DSCav1_mut2 (opt2)
  source 1..2130: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2963 - RNA, 2130 nt, synthetic construct
  misc_feature 1..2130: note = mRNA product Design f-1 comprising derived and/or modified sequence from HRSV(A2)__F-del_DSCav1_mut2 (opt3)
  source 1..2130: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2964 - RNA, 2130 nt, synthetic construct
  misc_feature 1..2130: note = mRNA product Design f-1 comprising derived and/or modified sequence from HRSV(A2)__F-del_DSCav1_mut2 (opt4)
  source 1..2130: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2965 - RNA, 2130 nt, synthetic construct
  misc_feature 1..2130: note = mRNA product Design f-1 comprising derived and/or modified sequence from HRSV(A2)__F-del_DSCav1_mut2 (opt5)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2966 - RNA, 2130 nt, synthetic construct
  misc_feature 1..2130: note = mRNA product Design f-1 comprising derived and/or modified sequence from HRSV(A2)__F-del_DSCav1_mut2 (opt6)
  source 1..2130: mol_type = other RNA
gggagagcggctcggccattttgtcccagtcagtccggaggctgcggctgcagaagtaccgcctgcggagtaactgcaaagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2967 - RNA, 2130 nt, synthetic construct
  misc_feature 1..2130: note = mRNA product Design f-1 comprising derived and/or modified sequence from HRSV(A2)__F-del_DSCav1_mut2 (opt11)
  source 1..2130: mol_type = other RNA
gggagagcggctcggccattttgtcccagtcagtccggaggctgcggctgcagaagtaccgcctgcggagtaactgcaaagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2968 - RNA, 1910 nt, synthetic construct
  misc_feature 1..1910: note = mRNA product Design f-2 comprising derived and/or modified sequence from HRSV(A2)__F-del_DSCav1_mut2 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2969 - RNA, 1910 nt, synthetic construct
  misc_feature 1..1910: note = mRNA product Design f-2 comprising derived and/or modified sequence from HRSV(A2)__F-del_DSCav1_mut2 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2970 - RNA, 1910 nt, synthetic construct
  misc_feature 1..1910: note = mRNA product Design f-2 comprising derived and/or modified sequence from HRSV(A2)__F-del_DSCav1_mut2 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2971 - RNA, 1910 nt, synthetic construct
  misc_feature 1..1910: note = mRNA product Design f-2 comprising derived and/or modified sequence from HRSV(A2)__F-del_DSCav1_mut2 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2972 - RNA, 1910 nt, synthetic construct
  misc_feature 1..1910: note = mRNA product Design f-2 comprising derived and/or modified sequence from HRSV(A2)__F-del_DSCav1_mut2 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2973 - RNA, 1910 nt, synthetic construct
  misc_feature 1..1910: note = mRNA product Design f-2 comprising derived and/or modified sequence from HRSV(A2)__F-del_DSCav1_mut2 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2974 - RNA, 1910 nt, synthetic construct
  misc_feature 1..1910: note = mRNA product Design f-2 comprising derived and/or modified sequence from HRSV(A2)__F-del_DSCav1_mut2 (opt6)
  source 1..1910: mol_type = other RNA
gggagagcggctcggccattttgtcccagtcagtccggaggctgcggctgcagaagtaccgcctgcggagtaactgcaaagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2975 - RNA, 1910 nt, synthetic construct
  misc_feature 1..1910: note = mRNA product Design f-2 comprising derived and/or modified sequence from HRSV(A2)__F-del_DSCav1_mut2 (opt11)
  source 1..1910: mol_type = other RNA
gggagagcggctcggccattttgtcccagtcagtccggaggctgcggctgcagaagtaccgcctgcggagtaactgcaaagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2976 - RNA, 1901 nt, synthetic construct
  misc_feature 1..1901: note = mRNA product Design f-3 comprising derived and/or modified sequence from HRSV(A2)__F-del_DSCav1_mut2 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2977 - RNA, 1901 nt, synthetic construct
  misc_feature 1..1901: note = mRNA product Design f-3 comprising derived and/or modified sequence from HRSV(A2)__F-del_DSCav1_mut2 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2978 - RNA, 1901 nt, synthetic construct
  misc_feature 1..1901: note = mRNA product Design f-3 comprising derived and/or modified sequence from HRSV(A2)__F-del_DSCav1_mut2 (opt2)
  source 1..1901: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2979 - RNA, 1901 nt, synthetic construct
  misc_feature 1..1901: note = mRNA product Design f-3 comprising derived and/or modified sequence from HRSV(A2)__F-del_DSCav1_mut2 (opt3)
  source 1..1901: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2980 - RNA, 1901 nt, synthetic construct
  misc_feature 1..1901: note = mRNA product Design f-3 comprising derived and/or modified sequence from HRSV(A2)__F-del_DSCav1_mut2 (opt4)
  source 1..1901: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2981 - RNA, 1901 nt, synthetic construct
  misc_feature 1..1901: note = mRNA product Design f-3 comprising derived and/or modified sequence from HRSV(A2)__F-del_DSCav1_mut2 (opt5)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2982 - RNA, 1901 nt, synthetic construct
  misc_feature 1..1901: note = mRNA product Design f-3 comprising derived and/or modified sequence from HRSV(A2)__F-del_DSCav1_mut2 (opt6)
  source 1..1901: mol_type = other RNA
gggagagtcccgcagtcggcgtccagcggctctgcttgttcgtgtgtgtgtcgttgcaggccttattcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2983 - RNA, 1901 nt, synthetic construct
  misc_feature 1..1901: note = mRNA product Design f-3 comprising derived and/or modified sequence from HRSV(A2)__F-del_DSCav1_mut2 (opt11)
  source 1..1901: mol_type = other RNA
gggagagtcccgcagtcggcgtccagcggctctgcttgttcgtgtgtgtgtcgttgcaggccttattcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2984 - RNA, 2117 nt, synthetic construct
  misc_feature 1..2117: note = mRNA product Design f-4 comprising derived and/or modified sequence from HRSV(A2)__F-del_DSCav1_mut2 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2985 - RNA, 2117 nt, synthetic construct
  misc_feature 1..2117: note = mRNA product Design f-4 comprising derived and/or modified sequence from HRSV(A2)__F-del_DSCav1_mut2 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2986 - RNA, 2117 nt, synthetic construct
  misc_feature 1..2117: note = mRNA product Design f-4 comprising derived and/or modified sequence from HRSV(A2)__F-del_DSCav1_mut2 (opt2)
  source 1..2117: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2987 - RNA, 2117 nt, synthetic construct
  misc_feature 1..2117: note = mRNA product Design f-4 comprising derived and/or modified sequence from HRSV(A2)__F-del_DSCav1_mut2 (opt3)
  source 1..2117: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2988 - RNA, 2117 nt, synthetic construct
  misc_feature 1..2117: note = mRNA product Design f-4 comprising derived and/or modified sequence from HRSV(A2)__F-del_DSCav1_mut2 (opt4)
  source 1..2117: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2989 - RNA, 2117 nt, synthetic construct
  misc_feature 1..2117: note = mRNA product Design f-4 comprising derived and/or modified sequence from HRSV(A2)__F-del_DSCav1_mut2 (opt5)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2990 - RNA, 2117 nt, synthetic construct
  misc_feature 1..2117: note = mRNA product Design f-4 comprising derived and/or modified sequence from HRSV(A2)__F-del_DSCav1_mut2 (opt6)
  source 1..2117: mol_type = other RNA
gggagagtcccgcagtcggcgtccagcggctctgcttgttcgtgtgtgtgtcgttgcaggccttattcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2991 - RNA, 2117 nt, synthetic construct
  misc_feature 1..2117: note = mRNA product Design f-4 comprising derived and/or modified sequence from HRSV(A2)__F-del_DSCav1_mut2 (opt11)
  source 1..2117: mol_type = other RNA
gggagagtcccgcagtcggcgtccagcggctctgcttgttcgtgtgtgtgtcgttgcaggccttattcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2992 - RNA, 1893 nt, synthetic construct
  misc_feature 1..1893: note = mRNA product Design f-5 comprising derived and/or modified sequence from HRSV(A2)__F-del_DSCav1_mut2 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2993 - RNA, 1893 nt, synthetic construct
  misc_feature 1..1893: note = mRNA product Design f-5 comprising derived and/or modified sequence from HRSV(A2)__F-del_DSCav1_mut2 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2994 - RNA, 1893 nt, synthetic construct
  misc_feature 1..1893: note = mRNA product Design f-5 comprising derived and/or modified sequence from HRSV(A2)__F-del_DSCav1_mut2 (opt2)
  source 1..1893: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2995 - RNA, 1893 nt, synthetic construct
  misc_feature 1..1893: note = mRNA product Design f-5 comprising derived and/or modified sequence from HRSV(A2)__F-del_DSCav1_mut2 (opt3)
  source 1..1893: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2996 - RNA, 1893 nt, synthetic construct
  misc_feature 1..1893: note = mRNA product Design f-5 comprising derived and/or modified sequence from HRSV(A2)__F-del_DSCav1_mut2 (opt4)
  source 1..1893: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2997 - RNA, 1893 nt, synthetic construct
  misc_feature 1..1893: note = mRNA product Design f-5 comprising derived and/or modified sequence from HRSV(A2)__F-del_DSCav1_mut2 (opt5)
  source 1..1893: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2998 - RNA, 1893 nt, synthetic construct
  misc_feature 1..1893: note = mRNA product Design f-5 comprising derived and/or modified sequence from HRSV(A2)__F-del_DSCav1_mut2 (opt6)
  source 1..1893: mol_type = other RNA
gggagactttcccattctgtagcagaatttggtgttgcctgtggtcttggtcccgcggagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 2999 - RNA, 1893 nt, synthetic construct
  misc_feature 1..1893: note = mRNA product Design f-5 comprising derived and/or modified sequence from HRSV(A2)__F-del_DSCav1_mut2 (opt11)
  source 1..1893: mol_type = other RNA
gggagactttcccattctgtagcagaatttggtgttgcctgtggtcttggtcccgcggagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3000 - RNA, 1889 nt, synthetic construct
  misc_feature 1..1889: note = mRNA product Design g-1 comprising derived and/or modified sequence from HRSV(A2)__F-del_DSCav1_mut2 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3001 - RNA, 1889 nt, synthetic construct
  misc_feature 1..1889: note = mRNA product Design g-1 comprising derived and/or modified sequence from HRSV(A2)__F-del_DSCav1_mut2 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3002 - RNA, 1889 nt, synthetic construct
  misc_feature 1..1889: note = mRNA product Design g-1 comprising derived and/or modified sequence from HRSV(A2)__F-del_DSCav1_mut2 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3003 - RNA, 1889 nt, synthetic construct
  misc_feature 1..1889: note = mRNA product Design g-1 comprising derived and/or modified sequence from HRSV(A2)__F-del_DSCav1_mut2 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3004 - RNA, 1889 nt, synthetic construct
  misc_feature 1..1889: note = mRNA product Design g-1 comprising derived and/or modified sequence from HRSV(A2)__F-del_DSCav1_mut2 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3005 - RNA, 1889 nt, synthetic construct
  misc_feature 1..1889: note = mRNA product Design g-1 comprising derived and/or modified sequence from HRSV(A2)__F-del_DSCav1_mut2 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3006 - RNA, 1889 nt, synthetic construct
  misc_feature 1..1889: note = mRNA product Design g-1 comprising derived and/or modified sequence from HRSV(A2)__F-del_DSCav1_mut2 (opt6)
  source 1..1889: mol_type = other RNA
gggagactttcccattctgtagcagaatttggtgttgcctgtggtcttggtcccgcggagaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3007 - RNA, 1889 nt, synthetic construct
  misc_feature 1..1889: note = mRNA product Design g-1 comprising derived and/or modified sequence from HRSV(A2)__F-del_DSCav1_mut2 (opt11)
  source 1..1889: mol_type = other RNA
gggagactttcccattctgtagcagaatttggtgttgcctgtggtcttggtcccgcggagaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3008 - RNA, 1904 nt, synthetic construct
  misc_feature 1..1904: note = mRNA product Design g-2 comprising derived and/or modified sequence from HRSV(A2)__F-del_DSCav1_mut2 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3009 - RNA, 1904 nt, synthetic construct
  misc_feature 1..1904: note = mRNA product Design g-2 comprising derived and/or modified sequence from HRSV(A2)__F-del_DSCav1_mut2 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3010 - RNA, 1904 nt, synthetic construct
  misc_feature 1..1904: note = mRNA product Design g-2 comprising derived and/or modified sequence from HRSV(A2)__F-del_DSCav1_mut2 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3011 - RNA, 1904 nt, synthetic construct
  misc_feature 1..1904: note = mRNA product Design g-2 comprising derived and/or modified sequence from HRSV(A2)__F-del_DSCav1_mut2 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3012 - RNA, 1904 nt, synthetic construct
  misc_feature 1..1904: note = mRNA product Design g-2 comprising derived and/or modified sequence from HRSV(A2)__F-del_DSCav1_mut2 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3013 - RNA, 1904 nt, synthetic construct
  misc_feature 1..1904: note = mRNA product Design g-2 comprising derived and/or modified sequence from HRSV(A2)__F-del_DSCav1_mut2 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3014 - RNA, 1904 nt, synthetic construct
  misc_feature 1..1904: note = mRNA product Design g-2 comprising derived and/or modified sequence from HRSV(A2)__F-del_DSCav1_mut2 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3015 - RNA, 1904 nt, synthetic construct
  misc_feature 1..1904: note = mRNA product Design g-2 comprising derived and/or modified sequence from HRSV(A2)__F-del_DSCav1_mut2 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3016 - RNA, 2136 nt, synthetic construct
  misc_feature 1..2136: note = mRNA product Design g-3 comprising derived and/or modified sequence from HRSV(A2)__F-del_DSCav1_mut2 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3017 - RNA, 2136 nt, synthetic construct
  misc_feature 1..2136: note = mRNA product Design g-3 comprising derived and/or modified sequence from HRSV(A2)__F-del_DSCav1_mut2 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3018 - RNA, 2136 nt, synthetic construct
  misc_feature 1..2136: note = mRNA product Design g-3 comprising derived and/or modified sequence from HRSV(A2)__F-del_DSCav1_mut2 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3019 - RNA, 2136 nt, synthetic construct
  misc_feature 1..2136: note = mRNA product Design g-3 comprising derived and/or modified sequence from HRSV(A2)__F-del_DSCav1_mut2 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3020 - RNA, 2136 nt, synthetic construct
  misc_feature 1..2136: note = mRNA product Design g-3 comprising derived and/or modified sequence from HRSV(A2)__F-del_DSCav1_mut2 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3021 - RNA, 2136 nt, synthetic construct
  misc_feature 1..2136: note = mRNA product Design g-3 comprising derived and/or modified sequence from HRSV(A2)__F-del_DSCav1_mut2 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3022 - RNA, 2136 nt, synthetic construct
  misc_feature 1..2136: note = mRNA product Design g-3 comprising derived and/or modified sequence from HRSV(A2)__F-del_DSCav1_mut2 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3023 - RNA, 2136 nt, synthetic construct
  misc_feature 1..2136: note = mRNA product Design g-3 comprising derived and/or modified sequence from HRSV(A2)__F-del_DSCav1_mut2 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3024 - RNA, 1931 nt, synthetic construct
  misc_feature 1..1931: note = mRNA product Design g-4 comprising derived and/or modified sequence from HRSV(A2)__F-del_DSCav1_mut2 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3025 - RNA, 1931 nt, synthetic construct
  misc_feature 1..1931: note = mRNA product Design g-4 comprising derived and/or modified sequence from HRSV(A2)__F-del_DSCav1_mut2 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3026 - RNA, 1931 nt, synthetic construct
  misc_feature 1..1931: note = mRNA product Design g-4 comprising derived and/or modified sequence from HRSV(A2)__F-del_DSCav1_mut2 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3027 - RNA, 1931 nt, synthetic construct
  misc_feature 1..1931: note = mRNA product Design g-4 comprising derived and/or modified sequence from HRSV(A2)__F-del_DSCav1_mut2 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3028 - RNA, 1931 nt, synthetic construct
  misc_feature 1..1931: note = mRNA product Design g-4 comprising derived and/or modified sequence from HRSV(A2)__F-del_DSCav1_mut2 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3029 - RNA, 1931 nt, synthetic construct
  misc_feature 1..1931: note = mRNA product Design g-4 comprising derived and/or modified sequence from HRSV(A2)__F-del_DSCav1_mut2 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3030 - RNA, 1931 nt, synthetic construct
  misc_feature 1..1931: note = mRNA product Design g-4 comprising derived and/or modified sequence from HRSV(A2)__F-del_DSCav1_mut2 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3031 - RNA, 1931 nt, synthetic construct
  misc_feature 1..1931: note = mRNA product Design g-4 comprising derived and/or modified sequence from HRSV(A2)__F-del_DSCav1_mut2 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3032 - RNA, 1907 nt, synthetic construct
  misc_feature 1..1907: note = mRNA product Design g-5 comprising derived and/or modified sequence from HRSV(A2)__F-del_DSCav1_mut2 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3033 - RNA, 1907 nt, synthetic construct
  misc_feature 1..1907: note = mRNA product Design g-5 comprising derived and/or modified sequence from HRSV(A2)__F-del_DSCav1_mut2 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3034 - RNA, 1907 nt, synthetic construct
  misc_feature 1..1907: note = mRNA product Design g-5 comprising derived and/or modified sequence from HRSV(A2)__F-del_DSCav1_mut2 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3035 - RNA, 1907 nt, synthetic construct
  misc_feature 1..1907: note = mRNA product Design g-5 comprising derived and/or modified sequence from HRSV(A2)__F-del_DSCav1_mut2 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3036 - RNA, 1907 nt, synthetic construct
  misc_feature 1..1907: note = mRNA product Design g-5 comprising derived and/or modified sequence from HRSV(A2)__F-del_DSCav1_mut2 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3037 - RNA, 1907 nt, synthetic construct
  misc_feature 1..1907: note = mRNA product Design g-5 comprising derived and/or modified sequence from HRSV(A2)__F-del_DSCav1_mut2 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3038 - RNA, 1907 nt, synthetic construct
  misc_feature 1..1907: note = mRNA product Design g-5 comprising derived and/or modified sequence from HRSV(A2)__F-del_DSCav1_mut2 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3039 - RNA, 1907 nt, synthetic construct
  misc_feature 1..1907: note = mRNA product Design g-5 comprising derived and/or modified sequence from HRSV(A2)__F-del_DSCav1_mut2 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3040 - RNA, 1923 nt, synthetic construct
  misc_feature 1..1923: note = mRNA product Design h-1 comprising derived and/or modified sequence from HRSV(A2)__F-del_DSCav1_mut2 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3041 - RNA, 1923 nt, synthetic construct
  misc_feature 1..1923: note = mRNA product Design h-1 comprising derived and/or modified sequence from HRSV(A2)__F-del_DSCav1_mut2 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3042 - RNA, 1923 nt, synthetic construct
  misc_feature 1..1923: note = mRNA product Design h-1 comprising derived and/or modified sequence from HRSV(A2)__F-del_DSCav1_mut2 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3043 - RNA, 1923 nt, synthetic construct
  misc_feature 1..1923: note = mRNA product Design h-1 comprising derived and/or modified sequence from HRSV(A2)__F-del_DSCav1_mut2 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3044 - RNA, 1923 nt, synthetic construct
  misc_feature 1..1923: note = mRNA product Design h-1 comprising derived and/or modified sequence from HRSV(A2)__F-del_DSCav1_mut2 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3045 - RNA, 1923 nt, synthetic construct
  misc_feature 1..1923: note = mRNA product Design h-1 comprising derived and/or modified sequence from HRSV(A2)__F-del_DSCav1_mut2 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3046 - RNA, 1923 nt, synthetic construct
  misc_feature 1..1923: note = mRNA product Design h-1 comprising derived and/or modified sequence from HRSV(A2)__F-del_DSCav1_mut2 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3047 - RNA, 1923 nt, synthetic construct
  misc_feature 1..1923: note = mRNA product Design h-1 comprising derived and/or modified sequence from HRSV(A2)__F-del_DSCav1_mut2 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3048 - RNA, 2139 nt, synthetic construct
  misc_feature 1..2139: note = mRNA product Design h-2 comprising derived and/or modified sequence from HRSV(A2)__F-del_DSCav1_mut2 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3049 - RNA, 2139 nt, synthetic construct
  misc_feature 1..2139: note = mRNA product Design h-2 comprising derived and/or modified sequence from HRSV(A2)__F-del_DSCav1_mut2 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3050 - RNA, 2139 nt, synthetic construct
  misc_feature 1..2139: note = mRNA product Design h-2 comprising derived and/or modified sequence from HRSV(A2)__F-del_DSCav1_mut2 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3051 - RNA, 2139 nt, synthetic construct
  misc_feature 1..2139: note = mRNA product Design h-2 comprising derived and/or modified sequence from HRSV(A2)__F-del_DSCav1_mut2 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3052 - RNA, 2139 nt, synthetic construct
  misc_feature 1..2139: note = mRNA product Design h-2 comprising derived and/or modified sequence from HRSV(A2)__F-del_DSCav1_mut2 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3053 - RNA, 2139 nt, synthetic construct
  misc_feature 1..2139: note = mRNA product Design h-2 comprising derived and/or modified sequence from HRSV(A2)__F-del_DSCav1_mut2 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3054 - RNA, 2139 nt, synthetic construct
  misc_feature 1..2139: note = mRNA product Design h-2 comprising derived and/or modified sequence from HRSV(A2)__F-del_DSCav1_mut2 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3055 - RNA, 2139 nt, synthetic construct
  misc_feature 1..2139: note = mRNA product Design h-2 comprising derived and/or modified sequence from HRSV(A2)__F-del_DSCav1_mut2 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3056 - RNA, 1919 nt, synthetic construct
  misc_feature 1..1919: note = mRNA product Design h-3 comprising derived and/or modified sequence from HRSV(A2)__F-del_DSCav1_mut2 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3057 - RNA, 1919 nt, synthetic construct
  misc_feature 1..1919: note = mRNA product Design h-3 comprising derived and/or modified sequence from HRSV(A2)__F-del_DSCav1_mut2 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3058 - RNA, 1919 nt, synthetic construct
  misc_feature 1..1919: note = mRNA product Design h-3 comprising derived and/or modified sequence from HRSV(A2)__F-del_DSCav1_mut2 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3059 - RNA, 1919 nt, synthetic construct
  misc_feature 1..1919: note = mRNA product Design h-3 comprising derived and/or modified sequence from HRSV(A2)__F-del_DSCav1_mut2 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3060 - RNA, 1919 nt, synthetic construct
  misc_feature 1..1919: note = mRNA product Design h-3 comprising derived and/or modified sequence from HRSV(A2)__F-del_DSCav1_mut2 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3061 - RNA, 1919 nt, synthetic construct
  misc_feature 1..1919: note = mRNA product Design h-3 comprising derived and/or modified sequence from HRSV(A2)__F-del_DSCav1_mut2 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3062 - RNA, 1919 nt, synthetic construct
  misc_feature 1..1919: note = mRNA product Design h-3 comprising derived and/or modified sequence from HRSV(A2)__F-del_DSCav1_mut2 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3063 - RNA, 1919 nt, synthetic construct
  misc_feature 1..1919: note = mRNA product Design h-3 comprising derived and/or modified sequence from HRSV(A2)__F-del_DSCav1_mut2 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3064 - RNA, 1982 nt, synthetic construct
  misc_feature 1..1982: note = mRNA product Design h-4 comprising derived and/or modified sequence from HRSV(A2)__F-del_DSCav1_mut2 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3065 - RNA, 1982 nt, synthetic construct
  misc_feature 1..1982: note = mRNA product Design h-4 comprising derived and/or modified sequence from HRSV(A2)__F-del_DSCav1_mut2 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3066 - RNA, 1982 nt, synthetic construct
  misc_feature 1..1982: note = mRNA product Design h-4 comprising derived and/or modified sequence from HRSV(A2)__F-del_DSCav1_mut2 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3067 - RNA, 1982 nt, synthetic construct
  misc_feature 1..1982: note = mRNA product Design h-4 comprising derived and/or modified sequence from HRSV(A2)__F-del_DSCav1_mut2 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3068 - RNA, 1982 nt, synthetic construct
  misc_feature 1..1982: note = mRNA product Design h-4 comprising derived and/or modified sequence from HRSV(A2)__F-del_DSCav1_mut2 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3069 - RNA, 1982 nt, synthetic construct
  misc_feature 1..1982: note = mRNA product Design h-4 comprising derived and/or modified sequence from HRSV(A2)__F-del_DSCav1_mut2 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3070 - RNA, 1982 nt, synthetic construct
  misc_feature 1..1982: note = mRNA product Design h-4 comprising derived and/or modified sequence from HRSV(A2)__F-del_DSCav1_mut2 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3071 - RNA, 1982 nt, synthetic construct
  misc_feature 1..1982: note = mRNA product Design h-4 comprising derived and/or modified sequence from HRSV(A2)__F-del_DSCav1_mut2 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3072 - RNA, 1998 nt, synthetic construct
  misc_feature 1..1998: note = mRNA product Design h-5 comprising derived and/or modified sequence from HRSV(A2)__F-del_DSCav1_mut2 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3073 - RNA, 1998 nt, synthetic construct
  misc_feature 1..1998: note = mRNA product Design h-5 comprising derived and/or modified sequence from HRSV(A2)__F-del_DSCav1_mut2 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3074 - RNA, 1998 nt, synthetic construct
  misc_feature 1..1998: note = mRNA product Design h-5 comprising derived and/or modified sequence from HRSV(A2)__F-del_DSCav1_mut2 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3075 - RNA, 1998 nt, synthetic construct
  misc_feature 1..1998: note = mRNA product Design h-5 comprising derived and/or modified sequence from HRSV(A2)__F-del_DSCav1_mut2 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3076 - RNA, 1998 nt, synthetic construct
  misc_feature 1..1998: note = mRNA product Design h-5 comprising derived and/or modified sequence from HRSV(A2)__F-del_DSCav1_mut2 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3077 - RNA, 1998 nt, synthetic construct
  misc_feature 1..1998: note = mRNA product Design h-5 comprising derived and/or modified sequence from HRSV(A2)__F-del_DSCav1_mut2 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3078 - RNA, 1998 nt, synthetic construct
  misc_feature 1..1998: note = mRNA product Design h-5 comprising derived and/or modified sequence from HRSV(A2)__F-del_DSCav1_mut2 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3079 - RNA, 1998 nt, synthetic construct
  misc_feature 1..1998: note = mRNA product Design h-5 comprising derived and/or modified sequence from HRSV(A2)__F-del_DSCav1_mut2 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3080 - RNA, 1931 nt, synthetic construct
  misc_feature 1..1931: note = mRNA product Design i-1 comprising derived and/or modified sequence from HRSV(A2)__F-del_DSCav1_mut2 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3081 - RNA, 1931 nt, synthetic construct
  misc_feature 1..1931: note = mRNA product Design i-1 comprising derived and/or modified sequence from HRSV(A2)__F-del_DSCav1_mut2 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3082 - RNA, 1931 nt, synthetic construct
  misc_feature 1..1931: note = mRNA product Design i-1 comprising derived and/or modified sequence from HRSV(A2)__F-del_DSCav1_mut2 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3083 - RNA, 1931 nt, synthetic construct
  misc_feature 1..1931: note = mRNA product Design i-1 comprising derived and/or modified sequence from HRSV(A2)__F-del_DSCav1_mut2 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3084 - RNA, 1931 nt, synthetic construct
  misc_feature 1..1931: note = mRNA product Design i-1 comprising derived and/or modified sequence from HRSV(A2)__F-del_DSCav1_mut2 (opt4)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3085 - RNA, 1931 nt, synthetic construct
  misc_feature 1..1931: note = mRNA product Design i-1 comprising derived and/or modified sequence from HRSV(A2)__F-del_DSCav1_mut2 (opt5)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3086 - RNA, 1931 nt, synthetic construct
  misc_feature 1..1931: note = mRNA product Design i-1 comprising derived and/or modified sequence from HRSV(A2)__F-del_DSCav1_mut2 (opt6)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3087 - RNA, 1931 nt, synthetic construct
  misc_feature 1..1931: note = mRNA product Design i-1 comprising derived and/or modified sequence from HRSV(A2)__F-del_DSCav1_mut2 (opt11)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3088 - RNA, 1931 nt, synthetic construct
  misc_feature 1..1931: note = mRNA product Design i-2 comprising derived and/or modified sequence from HRSV(A2)__F-del_DSCav1_mut2 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3089 - RNA, 1931 nt, synthetic construct
  misc_feature 1..1931: note = mRNA product Design i-2 comprising derived and/or modified sequence from HRSV(A2)__F-del_DSCav1_mut2 (opt1)
  source 1..1931: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3090 - RNA, 1931 nt, synthetic construct
  misc_feature 1..1931: note = mRNA product Design i-2 comprising derived and/or modified sequence from HRSV(A2)__F-del_DSCav1_mut2 (opt2)
  source 1..1931: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3091 - RNA, 1931 nt, synthetic construct
  misc_feature 1..1931: note = mRNA product Design i-2 comprising derived and/or modified sequence from HRSV(A2)__F-del_DSCav1_mut2 (opt3)
  source 1..1931: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3092 - RNA, 1931 nt, synthetic construct
  misc_feature 1..1931: note = mRNA product Design i-2 comprising derived and/or modified sequence from HRSV(A2)__F-del_DSCav1_mut2 (opt4)
  source 1..1931: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3093 - RNA, 1931 nt, synthetic construct
  misc_feature 1..1931: note = mRNA product Design i-2 comprising derived and/or modified sequence from HRSV(A2)__F-del_DSCav1_mut2 (opt5)
  source 1..1931: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3094 - RNA, 1931 nt, synthetic construct
  misc_feature 1..1931: note = mRNA product Design i-2 comprising derived and/or modified sequence from HRSV(A2)__F-del_DSCav1_mut2 (opt6)
  source 1..1931: mol_type = other RNA
gggagaggcgctgcctacggaggtggcagccatctccttctcggcatcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3095 - RNA, 1931 nt, synthetic construct
  misc_feature 1..1931: note = mRNA product Design i-2 comprising derived and/or modified sequence from HRSV(A2)__F-del_DSCav1_mut2 (opt11)
  source 1..1931: mol_type = other RNA
gggagaggcgctgcctacggaggtggcagccatctccttctcggcatcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3096 - RNA, 1927 nt, synthetic construct
  misc_feature 1..1927: note = mRNA product Design i-2 comprising derived and/or modified sequence from HRSV(A2)__F-del_DSCav1_mut2 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3097 - RNA, 1927 nt, synthetic construct
  misc_feature 1..1927: note = mRNA product Design i-2 comprising derived and/or modified sequence from HRSV(A2)__F-del_DSCav1_mut2 (opt1)
  source 1..1927: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3098 - RNA, 1927 nt, synthetic construct
  misc_feature 1..1927: note = mRNA product Design i-2 comprising derived and/or modified sequence from HRSV(A2)__F-del_DSCav1_mut2 (opt2)
  source 1..1927: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3099 - RNA, 1927 nt, synthetic construct
  misc_feature 1..1927: note = mRNA product Design i-2 comprising derived and/or modified sequence from HRSV(A2)__F-del_DSCav1_mut2 (opt3)
  source 1..1927: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3100 - RNA, 1927 nt, synthetic construct
  misc_feature 1..1927: note = mRNA product Design i-2 comprising derived and/or modified sequence from HRSV(A2)__F-del_DSCav1_mut2 (opt4)
  source 1..1927: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3101 - RNA, 1927 nt, synthetic construct
  misc_feature 1..1927: note = mRNA product Design i-2 comprising derived and/or modified sequence from HRSV(A2)__F-del_DSCav1_mut2 (opt5)
  source 1..1927: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3102 - RNA, 1927 nt, synthetic construct
  misc_feature 1..1927: note = mRNA product Design i-2 comprising derived and/or modified sequence from HRSV(A2)__F-del_DSCav1_mut2 (opt6)
  source 1..1927: mol_type = other RNA
ggggcgctgcctacggaggtggcagccatctccttctcggcatcaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3103 - RNA, 1927 nt, synthetic construct
  misc_feature 1..1927: note = mRNA product Design i-2 comprising derived and/or modified sequence from HRSV(A2)__F-del_DSCav1_mut2 (opt11)
  source 1..1927: mol_type = other RNA
ggggcgctgcctacggaggtggcagccatctccttctcggcatcaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3104 - RNA, 1762 nt, synthetic construct
  misc_feature 1..1762: note = mRNA product Design i-3 comprising derived and/or modified sequence from HRSV(A2)__F-del_DSCav1_mut2 (opt1) R6773
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagaacaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3105 - RNA, 1762 nt, synthetic construct
  misc_feature 1..1762: note = mRNA product Design i-3 comprising derived and/or modified sequence from HRSV(A2)__F-del_DSCav1_mut2 (opt1)
  source 1..1762: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagaacaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3106 - RNA, 1762 nt, synthetic construct
  misc_feature 1..1762: note = mRNA product Design i-3 comprising derived and/or modified sequence from HRSV(A2)__F-del_DSCav1_mut2 (opt2)
  source 1..1762: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagaacaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3107 - RNA, 1762 nt, synthetic construct
  misc_feature 1..1762: note = mRNA product Design i-3 comprising derived and/or modified sequence from HRSV(A2)__F-del_DSCav1_mut2 (opt3)
  source 1..1762: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagaataaatgcaacggcaccgacgccaaggtgaaactaatcaagcaggaactcgataagtataaaaatgcagtaactgacctgcagcttctgatgcagtccacacccgccaccgggtctggatcggctatatgttcaggcgtggcagtctgcaaggtgttgcacctcgagggtgaggttaacaaaatcaagagcgccctgctgagtacgaataaagctgtggtctccctctctaacggggtgagcgtattaacttttaaggttctggatcttaagaattacattgacaaacaattgctgcctatcctaaacaagcagtcctgttcaattccaaatatcgaaaccgtgatagagttccagcagaaaaacaataggctcctggaaattacacgggagtttagtgtcaacgccggagtgactaccccggtgagcacatatatgcttaccaattctgagctgttgtccctcatcaacgatatgcccattacgaacgaccaaaagaaactgatgtcaaataacgtccagatcgttcgccagcagagctacagtatcatgtgcattataaaggaagaggtgttagcgtatgtagtgcaactgcctctctacggcgtcatcgatactccatgttggaaacttcatacatctcccctgtgcaccactaatacaaaggaaggctccaacatttgtttgacccgaacggaccgtgggtggtactgcgataatgcaggaagcgtgtcgttctttcctcaggccgagacctgtaaggttcagtctaacagagtgttctgcgacacaatgaactccctaactctgccatcagaagtcaatctctgcaatgtggatatctttaaccccaaatatgactgtaagataatgaccagtaaaacagatgtaagctcctctgttattactagcctgggtgctatcgtgtcatgctacggcaagaccaaatgtacagccagtaataagaacagggggatcattaagaccttctccaatggatgcgactatgtcagcaacaaaggcgtggacactgtctctgtgggtaatacgctttactgtgttaacaagcaagaggggcagtcactgtatgtgaaaggagagcctatcattaacttttacgatccattggtattcccgagtgacgaatttgatgcaagcatatcccaggtcaatgagaagatcaaccagtctctcgctttcattcggaaatcggacgaactgttacacaatgtgaacgccggcaagagcacaaccaatatcatgatcactaccattataatcgttattatcgtgattctgctatccctcatcgcggtcggcctgcttttgtattgcaaggcccgctgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3108 - RNA, 1762 nt, synthetic construct
  misc_feature 1..1762: note = mRNA product Design i-3 comprising derived and/or modified sequence from HRSV(A2)__F-del_DSCav1_mut2 (opt4)
  source 1..1762: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagaacaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3109 - RNA, 1762 nt, synthetic construct
  misc_feature 1..1762: note = mRNA product Design i-3 comprising derived and/or modified sequence from HRSV(A2)__F-del_DSCav1_mut2 (opt5)
  source 1..1762: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagaataaatgcaacgggaccgacgccaaggtgaaacttatcaagcaggaactggataagtataaaaatgctgtgacggacctccagctgctgatgcagagcacccccgccacaggatccggctctgctatttgtagcggggtcgccgtgtgcaaggttctccacctggagggagaggtgaacaaaatcaagtccgcgcttctgagcaccaataaagccgtcgtgtctctctccaacggcgttagcgtgctgacatttaaggtccttgatctgaagaattacattgacaaacaactcctgcctatcctgaacaagcagtcttgttccattccgaatatcgaaaccgtgattgagttccagcagaaaaacaatcggctcctggaaatcacgcgcgagtttagcgtgaacgctggcgtcacaacccccgtttctacatatatgcttaccaattccgagctgctcagcctgatcaacgatatgcctattaccaacgaccaaaagaaacttatgtccaataacgtgcagatcgtgagacagcagtcttacagcattatgtgcatcattaaggaagaggtcctggcctatgtggttcaactccccctgtacggggtgatcgatacaccttgttggaaactgcatacgagccccctctgcaccacaaataccaaggaaggatccaacatctgtctgacacggaccgaccgcggctggtactgcgataatgctgggtctgtctccttctttcctcaggccgagacgtgtaaggtgcagagcaacagagttttctgcgacacaatgaactctcttaccctgccgagcgaagtgaatctctgcaatgtcgatatttttaaccccaaatatgactgtaagatcatgacctccaaaacagatgtgtctagctccgtcattaccagcctgggagcgatcgtgtcttgctacggcaagacaaaatgtacggcctccaataagaaccgggggattatcaagaccttcagcaatggatgcgactatgtttctaacaaaggcgtggacacagtctccgtgggcaataccctttactgtgttaacaagcaagaggggcagagcctgtatgtgaaaggagagcctatcattaacttttacgatcccctcgtcttcccttccgacgaatttgatgcttctatcagccaggtgaatgagaagattaaccagtccctggccttcatccgcaaatctgacgaactgctccacaatgtgaacgctggcaagagcacaaccaatattatgatcacgaccattatcatcgttattatcgtcattctgctttccctgatcgccgtggggctcctgctgtattgcaaggccagatgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3110 - RNA, 1762 nt, synthetic construct
  misc_feature 1..1762: note = mRNA product Design i-3 comprising derived and/or modified sequence from HRSV(A2)__F-del_DSCav1_mut2 (opt6)
  source 1..1762: mol_type = other RNA
gggagaaagcttaccatggaactcctaatacttaaagccaatgcaataaccacaatactaacagcagtaacattctgctttgcatcaggacaaaacataacagaagaattttaccaatcaacatgttcagcagtaagcaaaggatacctaggagccttacgcacaggttggtacacttccgtaataacaatagaactctcaaatataaaagaaaacaaatgcaacggaaccgatgcaaaagtaaaactaataaaacaagaattagacaaatacaaaaacgcagtaacagacctacaattacttatgcaatcaacacccgcaacaggatccggctcagcaatctgttcaggagtagcagtatgcaaagttctccacctagaaggcgaagtaaacaaaataaaatcagccctattatctaccaataaagcagtagtatcactatcaaatggagtatctgtcctaaccttcaaagtacttgacctaaaaaattacatcgacaaacaattactaccaatacttaacaaacaatcatgttcaataccaaacattgaaacagtaatagaatttcaacaaaaaaataacagattattagaaataacccgcgaattttcagttaacgcaggagtaacaacaccagtatccacatacatgttaacaaattcagaactcttatcacttataaacgacatgcccataacaaacgaccaaaaaaaactcatgtctaacaatgttcaaatagttcgacaacaatcatactccataatgtgcataataaaagaagaagttctagcatatgttgtacaactcccactctatggtgttatagacacaccatgctggaaactacatacaagccccttatgcactacaaacacaaaagaaggctctaatatatgtctaacccgcacagacagaggctggtattgcgataacgcaggttcagtatcattctttccacaagcagaaacttgcaaagtccaatccaatagagtcttctgcgacactatgaactcactcacactcccatctgaagtcaatttatgtaacgtcgatatcttcaacccaaaatacgactgcaaaataatgacctcaaaaacagacgtaagctcatcagtcataacttctctaggcgcaatcgtctcatgttacggcaaaacaaaatgtaccgcatcaaacaaaaatcgaggtataataaaaaccttttctaacggctgcgactacgtatcaaacaaaggagtagatactgtaagtgtcggaaacacattatactgcgtcaacaaacaagaaggacaatccctatatgttaaaggcgaacctatcattaatttctacgacccactcgtctttccatccgacgaatttgacgcatcaatttcccaagtaaatgaaaaaataaaccaatcccttgcattcataagaaaatcagatgaactattacacaacgtaaacgcaggcaaatcaacaacaaatataatgatcacaacaataataatcgtaataatagtaatcctactctcactaatagcagtaggcttactattatattgcaaagccagataaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3111 - RNA, 1762 nt, synthetic construct
  misc_feature 1..1762: note = mRNA product Design i-3 comprising derived and/or modified sequence from HRSV(A2)__F-del_DSCav1_mut2 (opt11)
  source 1..1762: mol_type = other RNA
gggagaaagcttaccatggaacttcttatcctaaaagcgaacgccataaccacaatcctaacagcagtcaccttctgtttcgcctcaggacaaaacatcaccgaggaattttaccaatccacatgtagcgctgtctcaaaaggctacctcggcgccctccgaaccggctggtacacatccgtaataacgatcgaactctccaacataaaagaaaataaatgcaacggcaccgacgccaaagtcaaacttatcaaacaagaactagacaaatacaaaaacgccgtcaccgacctccagctcctcatgcaatccaccccagcaacaggctccggaagcgcaatctgctcaggcgtcgccgtatgcaaagtactccacctcgaaggagaagtcaacaaaatcaaatccgccctcctatccacaaacaaagcagttgtctcactctccaacggggtaagcgtactgaccttcaaagtcctagacctcaaaaactacatcgataaacaactccttccaatcctcaacaaacaatcatgctctatccccaacatcgaaaccgtaatcgaatttcaacaaaaaaacaaccgcctacttgaaatcacacgcgaatttagcgtcaacgcaggagtaacaacacccgtgtccacatatatgctcacgaacagcgaactactatccctgattaacgacatgcccatcaccaacgaccaaaaaaaactaatgagcaacaacgtacaaatcgtccgccaacaaagctactctataatgtgcatcatcaaggaagaagtcctagcctacgtcgtccaattaccactctacggcgtcatcgacacaccctgctggaaactccatacatcccccctctgcaccaccaacaccaaagaagggtccaacatatgcctcactcgcacagaccgcggctggtactgcgacaacgctggcagcgtcagcttcttcccccaggccgaaacctgcaaagtccaatccaacagagtcttctgcgacaccatgaactcgctcaccctcccctccgaggtcaacctctgcaacgtcgacatattcaaccccaaatacgactgcaaaatcatgacctccaaaaccgacgtcagctcatcagtcatcacatccctcggggccatcgtctcctgctacggcaaaaccaagtgcaccgcctcaaacaaaaaccgcggcattatcaaaacattctccaacggctgcgactacgtctccaacaaaggcgtcgacacagtctccgtcggtaacaccctctactgcgtaaataaacaagaaggccaatccctctacgtcaaaggcgaacccatcatcaacttctacgaccctctcgtcttcccctccgacgaatttgacgcctcaatcagccaagttaacgaaaaaatcaaccaatcactcgccttcatccgcaaatccgacgaactcctccacaacgttaacgccggcaaatctaccacgaacatcatgatcaccaccataatcatcgtaattatcgtaatactcctatccctcatagcagtaggcctcctactctactgcaaagcccgttaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3112 - protein, 535 aa, synthetic construct
  REGION 1..535: note = derived and/or modified protein sequence (artificial) from HRSV(A2)__F_DSCav1_mut3
MELLILKANAITTILTAVTFCFASGQNITEEFYQSTCSAVSKGYLGALRTGWYTSVITIELSNIKEIKCNGTDAKVKLIKQELDKYKNAVTDLQLLMQSTPATGSGSAICSGVAVCKVLHLEGEVNKIKSALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNAGKSTTNIMITTIIIVIIVILLSLIAVGLLLYCKARSTPVTLSKDQLSGINNIAFSN

SEQ ID NO: 3113 - RNA, 1608 nt, synthetic construct
  misc_feature 1..1608: note = derived and/or modified CDS sequence (opt1) from HRSV(A2)__F_DSCav1_mut3
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactga

SEQ ID NO: 3114 - RNA, 1608 nt, synthetic construct
  misc_feature 1..1608: note = derived and/or modified CDS sequence (opt1) from HRSV(A2)__F_DSCav1_mut3
  source 1..1608: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactga

SEQ ID NO: 3115 - RNA, 1608 nt, synthetic construct
  misc_feature 1..1608: note = derived and/or modified CDS sequence (opt2) from HRSV(A2)__F_DSCav1_mut3
  source 1..1608: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactga

SEQ ID NO: 3116 - RNA, 1608 nt, synthetic construct
  misc_feature 1..1608: note = derived and/or modified CDS sequence (opt3) from HRSV(A2)__F_DSCav1_mut3
  source 1..1608: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattga

SEQ ID NO: 3117 - RNA, 1608 nt, synthetic construct
  misc_feature 1..1608: note = derived and/or modified CDS sequence (opt4) from HRSV(A2)__F_DSCav1_mut3
  source 1..1608: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactga

SEQ ID NO: 3118 - RNA, 1608 nt, synthetic construct
  misc_feature 1..1608: note = derived and/or modified CDS sequence (opt5) from HRSV(A2)__F_DSCav1_mut3
  source 1..1608: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattga

SEQ ID NO: 3119 - RNA, 1608 nt, synthetic construct
  misc_feature 1..1608: note = derived and/or modified CDS sequence (opt6) from HRSV(A2)__F_DSCav1_mut3
  source 1..1608: mol_type = other RNA
atggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaa

SEQ ID NO: 3120 - RNA, 1608 nt, synthetic construct
  misc_feature 1..1608: note = derived and/or modified CDS sequence (opt11) from HRSV(A2)__F_DSCav1_mut3
  source 1..1608: mol_type = other RNA
atggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaa

SEQ ID NO: 3121 - RNA, 1884 nt, synthetic construct
  misc_feature 1..1884: note = mRNA product Design a-1 comprising derived and/or modified sequence from HRSV(A2)__F_DSCav1_mut3 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3122 - RNA, 1884 nt, synthetic construct
  misc_feature 1..1884: note = mRNA product Design a-1 comprising derived and/or modified sequence from HRSV(A2)__F_DSCav1_mut3 (opt1)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3123 - RNA, 1884 nt, synthetic construct
  misc_feature 1..1884: note = mRNA product Design a-1 comprising derived and/or modified sequence from HRSV(A2)__F_DSCav1_mut3 (opt2)
  source 1..1884: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3124 - RNA, 1884 nt, synthetic construct
  misc_feature 1..1884: note = mRNA product Design a-1 comprising derived and/or modified sequence from HRSV(A2)__F_DSCav1_mut3 (opt3)
  source 1..1884: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3125 - RNA, 1884 nt, synthetic construct
  misc_feature 1..1884: note = mRNA product Design a-1 comprising derived and/or modified sequence from HRSV(A2)__F_DSCav1_mut3 (opt4)
  source 1..1884: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3126 - RNA, 1884 nt, synthetic construct
  misc_feature 1..1884: note = mRNA product Design a-1 comprising derived and/or modified sequence from HRSV(A2)__F_DSCav1_mut3 (opt5)
  source 1..1884: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3127 - RNA, 1884 nt, synthetic construct
  misc_feature 1..1884: note = mRNA product Design a-1 comprising derived and/or modified sequence from HRSV(A2)__F_DSCav1_mut3 (opt6)
  source 1..1884: mol_type = other RNA
gggagagtcccgcagtcggcgtccagcggctctgcttgttcgtgtgtgtgtcgttgcaggccttattcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3128 - RNA, 1884 nt, synthetic construct
  misc_feature 1..1884: note = mRNA product Design a-1 comprising derived and/or modified sequence from HRSV(A2)__F_DSCav1_mut3 (opt11)
  source 1..1884: mol_type = other RNA
gggagagtcccgcagtcggcgtccagcggctctgcttgttcgtgtgtgtgtcgttgcaggccttattcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3129 - RNA, 1903 nt, synthetic construct
  misc_feature 1..1903: note = mRNA product Design a-2 comprising derived and/or modified sequence from HRSV(A2)__F_DSCav1_mut3 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3130 - RNA, 1903 nt, synthetic construct
  misc_feature 1..1903: note = mRNA product Design a-2 comprising derived and/or modified sequence from HRSV(A2)__F_DSCav1_mut3 (opt1)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3131 - RNA, 1903 nt, synthetic construct
  misc_feature 1..1903: note = mRNA product Design a-2 comprising derived and/or modified sequence from HRSV(A2)__F_DSCav1_mut3 (opt2)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3132 - RNA, 1903 nt, synthetic construct
  misc_feature 1..1903: note = mRNA product Design a-2 comprising derived and/or modified sequence from HRSV(A2)__F_DSCav1_mut3 (opt3)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3133 - RNA, 1903 nt, synthetic construct
  misc_feature 1..1903: note = mRNA product Design a-2 comprising derived and/or modified sequence from HRSV(A2)__F_DSCav1_mut3 (opt4)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3134 - RNA, 1903 nt, synthetic construct
  misc_feature 1..1903: note = mRNA product Design a-2 comprising derived and/or modified sequence from HRSV(A2)__F_DSCav1_mut3 (opt5)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3135 - RNA, 1903 nt, synthetic construct
  misc_feature 1..1903: note = mRNA product Design a-2 comprising derived and/or modified sequence from HRSV(A2)__F_DSCav1_mut3 (opt6)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3136 - RNA, 1903 nt, synthetic construct
  misc_feature 1..1903: note = mRNA product Design a-2 comprising derived and/or modified sequence from HRSV(A2)__F_DSCav1_mut3 (opt11)
  source 1..1903: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3137 - RNA, 1981 nt, synthetic construct
  misc_feature 1..1981: note = mRNA product Design a-3 comprising derived and/or modified sequence from HRSV(A2)__F_DSCav1_mut3 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3138 - RNA, 1981 nt, synthetic construct
  misc_feature 1..1981: note = mRNA product Design a-3 comprising derived and/or modified sequence from HRSV(A2)__F_DSCav1_mut3 (opt1)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3139 - RNA, 1981 nt, synthetic construct
  misc_feature 1..1981: note = mRNA product Design a-3 comprising derived and/or modified sequence from HRSV(A2)__F_DSCav1_mut3 (opt2)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3140 - RNA, 1981 nt, synthetic construct
  misc_feature 1..1981: note = mRNA product Design a-3 comprising derived and/or modified sequence from HRSV(A2)__F_DSCav1_mut3 (opt3)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3141 - RNA, 1981 nt, synthetic construct
  misc_feature 1..1981: note = mRNA product Design a-3 comprising derived and/or modified sequence from HRSV(A2)__F_DSCav1_mut3 (opt4)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3142 - RNA, 1981 nt, synthetic construct
  misc_feature 1..1981: note = mRNA product Design a-3 comprising derived and/or modified sequence from HRSV(A2)__F_DSCav1_mut3 (opt5)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3143 - RNA, 1981 nt, synthetic construct
  misc_feature 1..1981: note = mRNA product Design a-3 comprising derived and/or modified sequence from HRSV(A2)__F_DSCav1_mut3 (opt6)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3144 - RNA, 1981 nt, synthetic construct
  misc_feature 1..1981: note = mRNA product Design a-3 comprising derived and/or modified sequence from HRSV(A2)__F_DSCav1_mut3 (opt11)
  source 1..1981: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3145 - RNA, 1930 nt, synthetic construct
  misc_feature 1..1930: note = mRNA product Design a-4 comprising derived and/or modified sequence from HRSV(A2)__F_DSCav1_mut3 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3146 - RNA, 1930 nt, synthetic construct
  misc_feature 1..1930: note = mRNA product Design a-4 comprising derived and/or modified sequence from HRSV(A2)__F_DSCav1_mut3 (opt1)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3147 - RNA, 1930 nt, synthetic construct
  misc_feature 1..1930: note = mRNA product Design a-4 comprising derived and/or modified sequence from HRSV(A2)__F_DSCav1_mut3 (opt2)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3148 - RNA, 1930 nt, synthetic construct
  misc_feature 1..1930: note = mRNA product Design a-4 comprising derived and/or modified sequence from HRSV(A2)__F_DSCav1_mut3 (opt3)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3149 - RNA, 1930 nt, synthetic construct
  misc_feature 1..1930: note = mRNA product Design a-4 comprising derived and/or modified sequence from HRSV(A2)__F_DSCav1_mut3 (opt4)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3150 - RNA, 1930 nt, synthetic construct
  misc_feature 1..1930: note = mRNA product Design a-4 comprising derived and/or modified sequence from HRSV(A2)__F_DSCav1_mut3 (opt5)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3151 - RNA, 1930 nt, synthetic construct
  misc_feature 1..1930: note = mRNA product Design a-4 comprising derived and/or modified sequence from HRSV(A2)__F_DSCav1_mut3 (opt6)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3152 - RNA, 1930 nt, synthetic construct
  misc_feature 1..1930: note = mRNA product Design a-4 comprising derived and/or modified sequence from HRSV(A2)__F_DSCav1_mut3 (opt11)
  source 1..1930: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3153 - RNA, 1876 nt, synthetic construct
  misc_feature 1..1876: note = mRNA product Design a-5 comprising derived and/or modified sequence from HRSV(A2)__F_DSCav1_mut3 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3154 - RNA, 1876 nt, synthetic construct
  misc_feature 1..1876: note = mRNA product Design a-5 comprising derived and/or modified sequence from HRSV(A2)__F_DSCav1_mut3 (opt1)
  source 1..1876: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3155 - RNA, 1876 nt, synthetic construct
  misc_feature 1..1876: note = mRNA product Design a-5 comprising derived and/or modified sequence from HRSV(A2)__F_DSCav1_mut3 (opt2)
  source 1..1876: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3156 - RNA, 1876 nt, synthetic construct
  misc_feature 1..1876: note = mRNA product Design a-5 comprising derived and/or modified sequence from HRSV(A2)__F_DSCav1_mut3 (opt3)
  source 1..1876: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3157 - RNA, 1876 nt, synthetic construct
  misc_feature 1..1876: note = mRNA product Design a-5 comprising derived and/or modified sequence from HRSV(A2)__F_DSCav1_mut3 (opt4)
  source 1..1876: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3158 - RNA, 1876 nt, synthetic construct
  misc_feature 1..1876: note = mRNA product Design a-5 comprising derived and/or modified sequence from HRSV(A2)__F_DSCav1_mut3 (opt5)
  source 1..1876: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3159 - RNA, 1876 nt, synthetic construct
  misc_feature 1..1876: note = mRNA product Design a-5 comprising derived and/or modified sequence from HRSV(A2)__F_DSCav1_mut3 (opt6)
  source 1..1876: mol_type = other RNA
gggagactttcccattctgtagcagaatttggtgttgcctgtggtcttggtcccgcggagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3160 - RNA, 1876 nt, synthetic construct
  misc_feature 1..1876: note = mRNA product Design a-5 comprising derived and/or modified sequence from HRSV(A2)__F_DSCav1_mut3 (opt11)
  source 1..1876: mol_type = other RNA
gggagactttcccattctgtagcagaatttggtgttgcctgtggtcttggtcccgcggagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3161 - RNA, 2057 nt, synthetic construct
  misc_feature 1..2057: note = mRNA product Design b-1 comprising derived and/or modified sequence from HRSV(A2)__F_DSCav1_mut3 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3162 - RNA, 2057 nt, synthetic construct
  misc_feature 1..2057: note = mRNA product Design b-1 comprising derived and/or modified sequence from HRSV(A2)__F_DSCav1_mut3 (opt1)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3163 - RNA, 2057 nt, synthetic construct
  misc_feature 1..2057: note = mRNA product Design b-1 comprising derived and/or modified sequence from HRSV(A2)__F_DSCav1_mut3 (opt2)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3164 - RNA, 2057 nt, synthetic construct
  misc_feature 1..2057: note = mRNA product Design b-1 comprising derived and/or modified sequence from HRSV(A2)__F_DSCav1_mut3 (opt3)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3165 - RNA, 2057 nt, synthetic construct
  misc_feature 1..2057: note = mRNA product Design b-1 comprising derived and/or modified sequence from HRSV(A2)__F_DSCav1_mut3 (opt4)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3166 - RNA, 2057 nt, synthetic construct
  misc_feature 1..2057: note = mRNA product Design b-1 comprising derived and/or modified sequence from HRSV(A2)__F_DSCav1_mut3 (opt5)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3167 - RNA, 2057 nt, synthetic construct
  misc_feature 1..2057: note = mRNA product Design b-1 comprising derived and/or modified sequence from HRSV(A2)__F_DSCav1_mut3 (opt6)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3168 - RNA, 2057 nt, synthetic construct
  misc_feature 1..2057: note = mRNA product Design b-1 comprising derived and/or modified sequence from HRSV(A2)__F_DSCav1_mut3 (opt11)
  source 1..2057: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3169 - RNA, 1877 nt, synthetic construct
  misc_feature 1..1877: note = mRNA product Design b-2 comprising derived and/or modified sequence from HRSV(A2)__F_DSCav1_mut3 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3170 - RNA, 1877 nt, synthetic construct
  misc_feature 1..1877: note = mRNA product Design b-2 comprising derived and/or modified sequence from HRSV(A2)__F_DSCav1_mut3 (opt1)
  source 1..1877: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3171 - RNA, 1877 nt, synthetic construct
  misc_feature 1..1877: note = mRNA product Design b-2 comprising derived and/or modified sequence from HRSV(A2)__F_DSCav1_mut3 (opt2)
  source 1..1877: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3172 - RNA, 1877 nt, synthetic construct
  misc_feature 1..1877: note = mRNA product Design b-2 comprising derived and/or modified sequence from HRSV(A2)__F_DSCav1_mut3 (opt3)
  source 1..1877: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3173 - RNA, 1877 nt, synthetic construct
  misc_feature 1..1877: note = mRNA product Design b-2 comprising derived and/or modified sequence from HRSV(A2)__F_DSCav1_mut3 (opt4)
  source 1..1877: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3174 - RNA, 1877 nt, synthetic construct
  misc_feature 1..1877: note = mRNA product Design b-2 comprising derived and/or modified sequence from HRSV(A2)__F_DSCav1_mut3 (opt5)
  source 1..1877: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3175 - RNA, 1877 nt, synthetic construct
  misc_feature 1..1877: note = mRNA product Design b-2 comprising derived and/or modified sequence from HRSV(A2)__F_DSCav1_mut3 (opt6)
  source 1..1877: mol_type = other RNA
gggagagcctctgctggagtccggggagtggcgttggctgctagagcgaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3176 - RNA, 1877 nt, synthetic construct
  misc_feature 1..1877: note = mRNA product Design b-2 comprising derived and/or modified sequence from HRSV(A2)__F_DSCav1_mut3 (opt11)
  source 1..1877: mol_type = other RNA
gggagagcctctgctggagtccggggagtggcgttggctgctagagcgaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3177 - RNA, 1897 nt, synthetic construct
  misc_feature 1..1897: note = mRNA product Design b-3 comprising derived and/or modified sequence from HRSV(A2)__F_DSCav1_mut3 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3178 - RNA, 1897 nt, synthetic construct
  misc_feature 1..1897: note = mRNA product Design b-3 comprising derived and/or modified sequence from HRSV(A2)__F_DSCav1_mut3 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3179 - RNA, 1897 nt, synthetic construct
  misc_feature 1..1897: note = mRNA product Design b-3 comprising derived and/or modified sequence from HRSV(A2)__F_DSCav1_mut3 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3180 - RNA, 1897 nt, synthetic construct
  misc_feature 1..1897: note = mRNA product Design b-3 comprising derived and/or modified sequence from HRSV(A2)__F_DSCav1_mut3 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3181 - RNA, 1897 nt, synthetic construct
  misc_feature 1..1897: note = mRNA product Design b-3 comprising derived and/or modified sequence from HRSV(A2)__F_DSCav1_mut3 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3182 - RNA, 1897 nt, synthetic construct
  misc_feature 1..1897: note = mRNA product Design b-3 comprising derived and/or modified sequence from HRSV(A2)__F_DSCav1_mut3 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3183 - RNA, 1897 nt, synthetic construct
  misc_feature 1..1897: note = mRNA product Design b-3 comprising derived and/or modified sequence from HRSV(A2)__F_DSCav1_mut3 (opt6)
  source 1..1897: mol_type = other RNA
gggagagtcccgcagtcggcgtccagcggctctgcttgttcgtgtgtgtgtcgttgcaggccttattcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3184 - RNA, 1897 nt, synthetic construct
  misc_feature 1..1897: note = mRNA product Design b-3 comprising derived and/or modified sequence from HRSV(A2)__F_DSCav1_mut3 (opt11)
  source 1..1897: mol_type = other RNA
gggagagtcccgcagtcggcgtccagcggctctgcttgttcgtgtgtgtgtcgttgcaggccttattcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3185 - RNA, 1948 nt, synthetic construct
  misc_feature 1..1948: note = mRNA product Design b-4 comprising derived and/or modified sequence from HRSV(A2)__F_DSCav1_mut3 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3186 - RNA, 1948 nt, synthetic construct
  misc_feature 1..1948: note = mRNA product Design b-4 comprising derived and/or modified sequence from HRSV(A2)__F_DSCav1_mut3 (opt1)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3187 - RNA, 1948 nt, synthetic construct
  misc_feature 1..1948: note = mRNA product Design b-4 comprising derived and/or modified sequence from HRSV(A2)__F_DSCav1_mut3 (opt2)
  source 1..1948: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3188 - RNA, 1948 nt, synthetic construct
  misc_feature 1..1948: note = mRNA product Design b-4 comprising derived and/or modified sequence from HRSV(A2)__F_DSCav1_mut3 (opt3)
  source 1..1948: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3189 - RNA, 1948 nt, synthetic construct
  misc_feature 1..1948: note = mRNA product Design b-4 comprising derived and/or modified sequence from HRSV(A2)__F_DSCav1_mut3 (opt4)
  source 1..1948: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3190 - RNA, 1948 nt, synthetic construct
  misc_feature 1..1948: note = mRNA product Design b-4 comprising derived and/or modified sequence from HRSV(A2)__F_DSCav1_mut3 (opt5)
  source 1..1948: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3191 - RNA, 1948 nt, synthetic construct
  misc_feature 1..1948: note = mRNA product Design b-4 comprising derived and/or modified sequence from HRSV(A2)__F_DSCav1_mut3 (opt6)
  source 1..1948: mol_type = other RNA
gggagagtcccgcagtcggcgtccagcggctctgcttgttcgtgtgtgtgtcgttgcaggccttattcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3192 - RNA, 1948 nt, synthetic construct
  misc_feature 1..1948: note = mRNA product Design b-4 comprising derived and/or modified sequence from HRSV(A2)__F_DSCav1_mut3 (opt11)
  source 1..1948: mol_type = other RNA
gggagagtcccgcagtcggcgtccagcggctctgcttgttcgtgtgtgtgtcgttgcaggccttattcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3193 - RNA, 2010 nt, synthetic construct
  misc_feature 1..2010: note = mRNA product Design b-5 comprising derived and/or modified sequence from HRSV(A2)__F_DSCav1_mut3 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3194 - RNA, 2010 nt, synthetic construct
  misc_feature 1..2010: note = mRNA product Design b-5 comprising derived and/or modified sequence from HRSV(A2)__F_DSCav1_mut3 (opt1)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3195 - RNA, 2010 nt, synthetic construct
  misc_feature 1..2010: note = mRNA product Design b-5 comprising derived and/or modified sequence from HRSV(A2)__F_DSCav1_mut3 (opt2)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3196 - RNA, 2010 nt, synthetic construct
  misc_feature 1..2010: note = mRNA product Design b-5 comprising derived and/or modified sequence from HRSV(A2)__F_DSCav1_mut3 (opt3)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3197 - RNA, 2010 nt, synthetic construct
  misc_feature 1..2010: note = mRNA product Design b-5 comprising derived and/or modified sequence from HRSV(A2)__F_DSCav1_mut3 (opt4)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3198 - RNA, 2010 nt, synthetic construct
  misc_feature 1..2010: note = mRNA product Design b-5 comprising derived and/or modified sequence from HRSV(A2)__F_DSCav1_mut3 (opt5)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3199 - RNA, 2010 nt, synthetic construct
  misc_feature 1..2010: note = mRNA product Design b-5 comprising derived and/or modified sequence from HRSV(A2)__F_DSCav1_mut3 (opt6)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3200 - RNA, 2010 nt, synthetic construct
  misc_feature 1..2010: note = mRNA product Design b-5 comprising derived and/or modified sequence from HRSV(A2)__F_DSCav1_mut3 (opt11)
  source 1..2010: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3201 - RNA, 1916 nt, synthetic construct
  misc_feature 1..1916: note = mRNA product Design c-1 comprising derived and/or modified sequence from HRSV(A2)__F_DSCav1_mut3 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3202 - RNA, 1916 nt, synthetic construct
  misc_feature 1..1916: note = mRNA product Design c-1 comprising derived and/or modified sequence from HRSV(A2)__F_DSCav1_mut3 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3203 - RNA, 1916 nt, synthetic construct
  misc_feature 1..1916: note = mRNA product Design c-1 comprising derived and/or modified sequence from HRSV(A2)__F_DSCav1_mut3 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3204 - RNA, 1916 nt, synthetic construct
  misc_feature 1..1916: note = mRNA product Design c-1 comprising derived and/or modified sequence from HRSV(A2)__F_DSCav1_mut3 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3205 - RNA, 1916 nt, synthetic construct
  misc_feature 1..1916: note = mRNA product Design c-1 comprising derived and/or modified sequence from HRSV(A2)__F_DSCav1_mut3 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3206 - RNA, 1916 nt, synthetic construct
  misc_feature 1..1916: note = mRNA product Design c-1 comprising derived and/or modified sequence from HRSV(A2)__F_DSCav1_mut3 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3207 - RNA, 1916 nt, synthetic construct
  misc_feature 1..1916: note = mRNA product Design c-1 comprising derived and/or modified sequence from HRSV(A2)__F_DSCav1_mut3 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3208 - RNA, 1916 nt, synthetic construct
  misc_feature 1..1916: note = mRNA product Design c-1 comprising derived and/or modified sequence from HRSV(A2)__F_DSCav1_mut3 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3209 - RNA, 2006 nt, synthetic construct
  misc_feature 1..2006: note = mRNA product Design c-2 comprising derived and/or modified sequence from HRSV(A2)__F_DSCav1_mut3 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3210 - RNA, 2006 nt, synthetic construct
  misc_feature 1..2006: note = mRNA product Design c-2 comprising derived and/or modified sequence from HRSV(A2)__F_DSCav1_mut3 (opt1)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3211 - RNA, 2006 nt, synthetic construct
  misc_feature 1..2006: note = mRNA product Design c-2 comprising derived and/or modified sequence from HRSV(A2)__F_DSCav1_mut3 (opt2)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3212 - RNA, 2006 nt, synthetic construct
  misc_feature 1..2006: note = mRNA product Design c-2 comprising derived and/or modified sequence from HRSV(A2)__F_DSCav1_mut3 (opt3)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3213 - RNA, 2006 nt, synthetic construct
  misc_feature 1..2006: note = mRNA product Design c-2 comprising derived and/or modified sequence from HRSV(A2)__F_DSCav1_mut3 (opt4)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3214 - RNA, 2006 nt, synthetic construct
  misc_feature 1..2006: note = mRNA product Design c-2 comprising derived and/or modified sequence from HRSV(A2)__F_DSCav1_mut3 (opt5)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3215 - RNA, 2006 nt, synthetic construct
  misc_feature 1..2006: note = mRNA product Design c-2 comprising derived and/or modified sequence from HRSV(A2)__F_DSCav1_mut3 (opt6)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3216 - RNA, 2006 nt, synthetic construct
  misc_feature 1..2006: note = mRNA product Design c-2 comprising derived and/or modified sequence from HRSV(A2)__F_DSCav1_mut3 (opt11)
  source 1..2006: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3217 - RNA, 1983 nt, synthetic construct
  misc_feature 1..1983: note = mRNA product Design c-3 comprising derived and/or modified sequence from HRSV(A2)__F_DSCav1_mut3 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3218 - RNA, 1983 nt, synthetic construct
  misc_feature 1..1983: note = mRNA product Design c-3 comprising derived and/or modified sequence from HRSV(A2)__F_DSCav1_mut3 (opt1)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3219 - RNA, 1983 nt, synthetic construct
  misc_feature 1..1983: note = mRNA product Design c-3 comprising derived and/or modified sequence from HRSV(A2)__F_DSCav1_mut3 (opt2)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3220 - RNA, 1983 nt, synthetic construct
  misc_feature 1..1983: note = mRNA product Design c-3 comprising derived and/or modified sequence from HRSV(A2)__F_DSCav1_mut3 (opt3)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3221 - RNA, 1983 nt, synthetic construct
  misc_feature 1..1983: note = mRNA product Design c-3 comprising derived and/or modified sequence from HRSV(A2)__F_DSCav1_mut3 (opt4)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3222 - RNA, 1983 nt, synthetic construct
  misc_feature 1..1983: note = mRNA product Design c-3 comprising derived and/or modified sequence from HRSV(A2)__F_DSCav1_mut3 (opt5)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3223 - RNA, 1983 nt, synthetic construct
  misc_feature 1..1983: note = mRNA product Design c-3 comprising derived and/or modified sequence from HRSV(A2)__F_DSCav1_mut3 (opt6)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3224 - RNA, 1983 nt, synthetic construct
  misc_feature 1..1983: note = mRNA product Design c-3 comprising derived and/or modified sequence from HRSV(A2)__F_DSCav1_mut3 (opt11)
  source 1..1983: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3225 - RNA, 1979 nt, synthetic construct
  misc_feature 1..1979: note = mRNA product Design c-4 comprising derived and/or modified sequence from HRSV(A2)__F_DSCav1_mut3 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3226 - RNA, 1979 nt, synthetic construct
  misc_feature 1..1979: note = mRNA product Design c-4 comprising derived and/or modified sequence from HRSV(A2)__F_DSCav1_mut3 (opt1)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3227 - RNA, 1979 nt, synthetic construct
  misc_feature 1..1979: note = mRNA product Design c-4 comprising derived and/or modified sequence from HRSV(A2)__F_DSCav1_mut3 (opt2)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3228 - RNA, 1979 nt, synthetic construct
  misc_feature 1..1979: note = mRNA product Design c-4 comprising derived and/or modified sequence from HRSV(A2)__F_DSCav1_mut3 (opt3)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3229 - RNA, 1979 nt, synthetic construct
  misc_feature 1..1979: note = mRNA product Design c-4 comprising derived and/or modified sequence from HRSV(A2)__F_DSCav1_mut3 (opt4)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3230 - RNA, 1979 nt, synthetic construct
  misc_feature 1..1979: note = mRNA product Design c-4 comprising derived and/or modified sequence from HRSV(A2)__F_DSCav1_mut3 (opt5)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3231 - RNA, 1979 nt, synthetic construct
  misc_feature 1..1979: note = mRNA product Design c-4 comprising derived and/or modified sequence from HRSV(A2)__F_DSCav1_mut3 (opt6)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3232 - RNA, 1979 nt, synthetic construct
  misc_feature 1..1979: note = mRNA product Design c-4 comprising derived and/or modified sequence from HRSV(A2)__F_DSCav1_mut3 (opt11)
  source 1..1979: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3233 - RNA, 1897 nt, synthetic construct
  misc_feature 1..1897: note = mRNA product Design c-5 comprising derived and/or modified sequence from HRSV(A2)__F_DSCav1_mut3 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3234 - RNA, 1897 nt, synthetic construct
  misc_feature 1..1897: note = mRNA product Design c-5 comprising derived and/or modified sequence from HRSV(A2)__F_DSCav1_mut3 (opt1)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3235 - RNA, 1897 nt, synthetic construct
  misc_feature 1..1897: note = mRNA product Design c-5 comprising derived and/or modified sequence from HRSV(A2)__F_DSCav1_mut3 (opt2)
  source 1..1897: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3236 - RNA, 1897 nt, synthetic construct
  misc_feature 1..1897: note = mRNA product Design c-5 comprising derived and/or modified sequence from HRSV(A2)__F_DSCav1_mut3 (opt3)
  source 1..1897: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3237 - RNA, 1897 nt, synthetic construct
  misc_feature 1..1897: note = mRNA product Design c-5 comprising derived and/or modified sequence from HRSV(A2)__F_DSCav1_mut3 (opt4)
  source 1..1897: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3238 - RNA, 1897 nt, synthetic construct
  misc_feature 1..1897: note = mRNA product Design c-5 comprising derived and/or modified sequence from HRSV(A2)__F_DSCav1_mut3 (opt5)
  source 1..1897: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3239 - RNA, 1897 nt, synthetic construct
  misc_feature 1..1897: note = mRNA product Design c-5 comprising derived and/or modified sequence from HRSV(A2)__F_DSCav1_mut3 (opt6)
  source 1..1897: mol_type = other RNA
gggagagcggctcggccattttgtcccagtcagtccggaggctgcggctgcagaagtaccgcctgcggagtaactgcaaagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3240 - RNA, 1897 nt, synthetic construct
  misc_feature 1..1897: note = mRNA product Design c-5 comprising derived and/or modified sequence from HRSV(A2)__F_DSCav1_mut3 (opt11)
  source 1..1897: mol_type = other RNA
gggagagcggctcggccattttgtcccagtcagtccggaggctgcggctgcagaagtaccgcctgcggagtaactgcaaagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3241 - RNA, 1906 nt, synthetic construct
  misc_feature 1..1906: note = mRNA product Design d-1 comprising derived and/or modified sequence from HRSV(A2)__F_DSCav1_mut3 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3242 - RNA, 1906 nt, synthetic construct
  misc_feature 1..1906: note = mRNA product Design d-1 comprising derived and/or modified sequence from HRSV(A2)__F_DSCav1_mut3 (opt1)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3243 - RNA, 1906 nt, synthetic construct
  misc_feature 1..1906: note = mRNA product Design d-1 comprising derived and/or modified sequence from HRSV(A2)__F_DSCav1_mut3 (opt2)
  source 1..1906: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3244 - RNA, 1906 nt, synthetic construct
  misc_feature 1..1906: note = mRNA product Design d-1 comprising derived and/or modified sequence from HRSV(A2)__F_DSCav1_mut3 (opt3)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3245 - RNA, 1906 nt, synthetic construct
  misc_feature 1..1906: note = mRNA product Design d-1 comprising derived and/or modified sequence from HRSV(A2)__F_DSCav1_mut3 (opt4)
  source 1..1906: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3246 - RNA, 1906 nt, synthetic construct
  misc_feature 1..1906: note = mRNA product Design d-1 comprising derived and/or modified sequence from HRSV(A2)__F_DSCav1_mut3 (opt5)
  source 1..1906: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3247 - RNA, 1906 nt, synthetic construct
  misc_feature 1..1906: note = mRNA product Design d-1 comprising derived and/or modified sequence from HRSV(A2)__F_DSCav1_mut3 (opt6)
  source 1..1906: mol_type = other RNA
gggagacccgtgacccggaagttgtacggctacgcgactttccctcccacaaaccctcgcgcccttcctttcctacttgggcccggcagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3248 - RNA, 1906 nt, synthetic construct
  misc_feature 1..1906: note = mRNA product Design d-1 comprising derived and/or modified sequence from HRSV(A2)__F_DSCav1_mut3 (opt11)
  source 1..1906: mol_type = other RNA
gggagacccgtgacccggaagttgtacggctacgcgactttccctcccacaaaccctcgcgcccttcctttcctacttgggcccggcagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3249 - RNA, 1961 nt, synthetic construct
  misc_feature 1..1961: note = mRNA product Design d-2 comprising derived and/or modified sequence from HRSV(A2)__F_DSCav1_mut3 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3250 - RNA, 1961 nt, synthetic construct
  misc_feature 1..1961: note = mRNA product Design d-2 comprising derived and/or modified sequence from HRSV(A2)__F_DSCav1_mut3 (opt1)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3251 - RNA, 1961 nt, synthetic construct
  misc_feature 1..1961: note = mRNA product Design d-2 comprising derived and/or modified sequence from HRSV(A2)__F_DSCav1_mut3 (opt2)
  source 1..1961: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3252 - RNA, 1961 nt, synthetic construct
  misc_feature 1..1961: note = mRNA product Design d-2 comprising derived and/or modified sequence from HRSV(A2)__F_DSCav1_mut3 (opt3)
  source 1..1961: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3253 - RNA, 1961 nt, synthetic construct
  misc_feature 1..1961: note = mRNA product Design d-2 comprising derived and/or modified sequence from HRSV(A2)__F_DSCav1_mut3 (opt4)
  source 1..1961: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3254 - RNA, 1961 nt, synthetic construct
  misc_feature 1..1961: note = mRNA product Design d-2 comprising derived and/or modified sequence from HRSV(A2)__F_DSCav1_mut3 (opt5)
  source 1..1961: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3255 - RNA, 1961 nt, synthetic construct
  misc_feature 1..1961: note = mRNA product Design d-2 comprising derived and/or modified sequence from HRSV(A2)__F_DSCav1_mut3 (opt6)
  source 1..1961: mol_type = other RNA
gggagagcggctcggccattttgtcccagtcagtccggaggctgcggctgcagaagtaccgcctgcggagtaactgcaaagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3256 - RNA, 1961 nt, synthetic construct
  misc_feature 1..1961: note = mRNA product Design d-2 comprising derived and/or modified sequence from HRSV(A2)__F_DSCav1_mut3 (opt11)
  source 1..1961: mol_type = other RNA
gggagagcggctcggccattttgtcccagtcagtccggaggctgcggctgcagaagtaccgcctgcggagtaactgcaaagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3257 - RNA, 2277 nt, synthetic construct
  misc_feature 1..2277: note = mRNA product Design d-3 comprising derived and/or modified sequence from HRSV(A2)__F_DSCav1_mut3 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3258 - RNA, 2277 nt, synthetic construct
  misc_feature 1..2277: note = mRNA product Design d-3 comprising derived and/or modified sequence from HRSV(A2)__F_DSCav1_mut3 (opt1)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3259 - RNA, 2277 nt, synthetic construct
  misc_feature 1..2277: note = mRNA product Design d-3 comprising derived and/or modified sequence from HRSV(A2)__F_DSCav1_mut3 (opt2)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3260 - RNA, 2277 nt, synthetic construct
  misc_feature 1..2277: note = mRNA product Design d-3 comprising derived and/or modified sequence from HRSV(A2)__F_DSCav1_mut3 (opt3)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3261 - RNA, 2277 nt, synthetic construct
  misc_feature 1..2277: note = mRNA product Design d-3 comprising derived and/or modified sequence from HRSV(A2)__F_DSCav1_mut3 (opt4)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3262 - RNA, 2277 nt, synthetic construct
  misc_feature 1..2277: note = mRNA product Design d-3 comprising derived and/or modified sequence from HRSV(A2)__F_DSCav1_mut3 (opt5)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3263 - RNA, 2277 nt, synthetic construct
  misc_feature 1..2277: note = mRNA product Design d-3 comprising derived and/or modified sequence from HRSV(A2)__F_DSCav1_mut3 (opt6)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3264 - RNA, 2277 nt, synthetic construct
  misc_feature 1..2277: note = mRNA product Design d-3 comprising derived and/or modified sequence from HRSV(A2)__F_DSCav1_mut3 (opt11)
  source 1..2277: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3265 - RNA, 1960 nt, synthetic construct
  misc_feature 1..1960: note = mRNA product Design d-4 comprising derived and/or modified sequence from HRSV(A2)__F_DSCav1_mut3 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3266 - RNA, 1960 nt, synthetic construct
  misc_feature 1..1960: note = mRNA product Design d-4 comprising derived and/or modified sequence from HRSV(A2)__F_DSCav1_mut3 (opt1)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3267 - RNA, 1960 nt, synthetic construct
  misc_feature 1..1960: note = mRNA product Design d-4 comprising derived and/or modified sequence from HRSV(A2)__F_DSCav1_mut3 (opt2)
  source 1..1960: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3268 - RNA, 1960 nt, synthetic construct
  misc_feature 1..1960: note = mRNA product Design d-4 comprising derived and/or modified sequence from HRSV(A2)__F_DSCav1_mut3 (opt3)
  source 1..1960: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3269 - RNA, 1960 nt, synthetic construct
  misc_feature 1..1960: note = mRNA product Design d-4 comprising derived and/or modified sequence from HRSV(A2)__F_DSCav1_mut3 (opt4)
  source 1..1960: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3270 - RNA, 1960 nt, synthetic construct
  misc_feature 1..1960: note = mRNA product Design d-4 comprising derived and/or modified sequence from HRSV(A2)__F_DSCav1_mut3 (opt5)
  source 1..1960: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3271 - RNA, 1960 nt, synthetic construct
  misc_feature 1..1960: note = mRNA product Design d-4 comprising derived and/or modified sequence from HRSV(A2)__F_DSCav1_mut3 (opt6)
  source 1..1960: mol_type = other RNA
gggagagtcccgcagtcggcgtccagcggctctgcttgttcgtgtgtgtgtcgttgcaggccttattcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3272 - RNA, 1960 nt, synthetic construct
  misc_feature 1..1960: note = mRNA product Design d-4 comprising derived and/or modified sequence from HRSV(A2)__F_DSCav1_mut3 (opt11)
  source 1..1960: mol_type = other RNA
gggagagtcccgcagtcggcgtccagcggctctgcttgttcgtgtgtgtgtcgttgcaggccttattcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3273 - RNA, 2057 nt, synthetic construct
  misc_feature 1..2057: note = mRNA product Design d-5 comprising derived and/or modified sequence from HRSV(A2)__F_DSCav1_mut3 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3274 - RNA, 2057 nt, synthetic construct
  misc_feature 1..2057: note = mRNA product Design d-5 comprising derived and/or modified sequence from HRSV(A2)__F_DSCav1_mut3 (opt1)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3275 - RNA, 2057 nt, synthetic construct
  misc_feature 1..2057: note = mRNA product Design d-5 comprising derived and/or modified sequence from HRSV(A2)__F_DSCav1_mut3 (opt2)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3276 - RNA, 2057 nt, synthetic construct
  misc_feature 1..2057: note = mRNA product Design d-5 comprising derived and/or modified sequence from HRSV(A2)__F_DSCav1_mut3 (opt3)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3277 - RNA, 2057 nt, synthetic construct
  misc_feature 1..2057: note = mRNA product Design d-5 comprising derived and/or modified sequence from HRSV(A2)__F_DSCav1_mut3 (opt4)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3278 - RNA, 2057 nt, synthetic construct
  misc_feature 1..2057: note = mRNA product Design d-5 comprising derived and/or modified sequence from HRSV(A2)__F_DSCav1_mut3 (opt5)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3279 - RNA, 2057 nt, synthetic construct
  misc_feature 1..2057: note = mRNA product Design d-5 comprising derived and/or modified sequence from HRSV(A2)__F_DSCav1_mut3 (opt6)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3280 - RNA, 2057 nt, synthetic construct
  misc_feature 1..2057: note = mRNA product Design d-5 comprising derived and/or modified sequence from HRSV(A2)__F_DSCav1_mut3 (opt11)
  source 1..2057: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3281 - RNA, 1937 nt, synthetic construct
  misc_feature 1..1937: note = mRNA product Design e-1 comprising derived and/or modified sequence from HRSV(A2)__F_DSCav1_mut3 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3282 - RNA, 1937 nt, synthetic construct
  misc_feature 1..1937: note = mRNA product Design e-1 comprising derived and/or modified sequence from HRSV(A2)__F_DSCav1_mut3 (opt1)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3283 - RNA, 1937 nt, synthetic construct
  misc_feature 1..1937: note = mRNA product Design e-1 comprising derived and/or modified sequence from HRSV(A2)__F_DSCav1_mut3 (opt2)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3284 - RNA, 1937 nt, synthetic construct
  misc_feature 1..1937: note = mRNA product Design e-1 comprising derived and/or modified sequence from HRSV(A2)__F_DSCav1_mut3 (opt3)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3285 - RNA, 1937 nt, synthetic construct
  misc_feature 1..1937: note = mRNA product Design e-1 comprising derived and/or modified sequence from HRSV(A2)__F_DSCav1_mut3 (opt4)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3286 - RNA, 1937 nt, synthetic construct
  misc_feature 1..1937: note = mRNA product Design e-1 comprising derived and/or modified sequence from HRSV(A2)__F_DSCav1_mut3 (opt5)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3287 - RNA, 1937 nt, synthetic construct
  misc_feature 1..1937: note = mRNA product Design e-1 comprising derived and/or modified sequence from HRSV(A2)__F_DSCav1_mut3 (opt6)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3288 - RNA, 1937 nt, synthetic construct
  misc_feature 1..1937: note = mRNA product Design e-1 comprising derived and/or modified sequence from HRSV(A2)__F_DSCav1_mut3 (opt11)
  source 1..1937: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3289 - RNA, 1919 nt, synthetic construct
  misc_feature 1..1919: note = mRNA product Design e-2 comprising derived and/or modified sequence from HRSV(A2)__F_DSCav1_mut3 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3290 - RNA, 1919 nt, synthetic construct
  misc_feature 1..1919: note = mRNA product Design e-2 comprising derived and/or modified sequence from HRSV(A2)__F_DSCav1_mut3 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3291 - RNA, 1919 nt, synthetic construct
  misc_feature 1..1919: note = mRNA product Design e-2 comprising derived and/or modified sequence from HRSV(A2)__F_DSCav1_mut3 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3292 - RNA, 1919 nt, synthetic construct
  misc_feature 1..1919: note = mRNA product Design e-2 comprising derived and/or modified sequence from HRSV(A2)__F_DSCav1_mut3 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3293 - RNA, 1919 nt, synthetic construct
  misc_feature 1..1919: note = mRNA product Design e-2 comprising derived and/or modified sequence from HRSV(A2)__F_DSCav1_mut3 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3294 - RNA, 1919 nt, synthetic construct
  misc_feature 1..1919: note = mRNA product Design e-2 comprising derived and/or modified sequence from HRSV(A2)__F_DSCav1_mut3 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3295 - RNA, 1919 nt, synthetic construct
  misc_feature 1..1919: note = mRNA product Design e-2 comprising derived and/or modified sequence from HRSV(A2)__F_DSCav1_mut3 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3296 - RNA, 1919 nt, synthetic construct
  misc_feature 1..1919: note = mRNA product Design e-2 comprising derived and/or modified sequence from HRSV(A2)__F_DSCav1_mut3 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3297 - RNA, 1889 nt, synthetic construct
  misc_feature 1..1889: note = mRNA product Design e-3 comprising derived and/or modified sequence from HRSV(A2)__F_DSCav1_mut3 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3298 - RNA, 1889 nt, synthetic construct
  misc_feature 1..1889: note = mRNA product Design e-3 comprising derived and/or modified sequence from HRSV(A2)__F_DSCav1_mut3 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3299 - RNA, 1889 nt, synthetic construct
  misc_feature 1..1889: note = mRNA product Design e-3 comprising derived and/or modified sequence from HRSV(A2)__F_DSCav1_mut3 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3300 - RNA, 1889 nt, synthetic construct
  misc_feature 1..1889: note = mRNA product Design e-3 comprising derived and/or modified sequence from HRSV(A2)__F_DSCav1_mut3 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3301 - RNA, 1889 nt, synthetic construct
  misc_feature 1..1889: note = mRNA product Design e-3 comprising derived and/or modified sequence from HRSV(A2)__F_DSCav1_mut3 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3302 - RNA, 1889 nt, synthetic construct
  misc_feature 1..1889: note = mRNA product Design e-3 comprising derived and/or modified sequence from HRSV(A2)__F_DSCav1_mut3 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3303 - RNA, 1889 nt, synthetic construct
  misc_feature 1..1889: note = mRNA product Design e-3 comprising derived and/or modified sequence from HRSV(A2)__F_DSCav1_mut3 (opt6)
  source 1..1889: mol_type = other RNA
gggagactttcccattctgtagcagaatttggtgttgcctgtggtcttggtcccgcggagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3304 - RNA, 1889 nt, synthetic construct
  misc_feature 1..1889: note = mRNA product Design e-3 comprising derived and/or modified sequence from HRSV(A2)__F_DSCav1_mut3 (opt11)
  source 1..1889: mol_type = other RNA
gggagactttcccattctgtagcagaatttggtgttgcctgtggtcttggtcccgcggagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3305 - RNA, 1943 nt, synthetic construct
  misc_feature 1..1943: note = mRNA product Design e-4 comprising derived and/or modified sequence from HRSV(A2)__F_DSCav1_mut3 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3306 - RNA, 1943 nt, synthetic construct
  misc_feature 1..1943: note = mRNA product Design e-4 comprising derived and/or modified sequence from HRSV(A2)__F_DSCav1_mut3 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3307 - RNA, 1943 nt, synthetic construct
  misc_feature 1..1943: note = mRNA product Design e-4 comprising derived and/or modified sequence from HRSV(A2)__F_DSCav1_mut3 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3308 - RNA, 1943 nt, synthetic construct
  misc_feature 1..1943: note = mRNA product Design e-4 comprising derived and/or modified sequence from HRSV(A2)__F_DSCav1_mut3 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3309 - RNA, 1943 nt, synthetic construct
  misc_feature 1..1943: note = mRNA product Design e-4 comprising derived and/or modified sequence from HRSV(A2)__F_DSCav1_mut3 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3310 - RNA, 1943 nt, synthetic construct
  misc_feature 1..1943: note = mRNA product Design e-4 comprising derived and/or modified sequence from HRSV(A2)__F_DSCav1_mut3 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3311 - RNA, 1943 nt, synthetic construct
  misc_feature 1..1943: note = mRNA product Design e-4 comprising derived and/or modified sequence from HRSV(A2)__F_DSCav1_mut3 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3312 - RNA, 1943 nt, synthetic construct
  misc_feature 1..1943: note = mRNA product Design e-4 comprising derived and/or modified sequence from HRSV(A2)__F_DSCav1_mut3 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3313 - RNA, 1910 nt, synthetic construct
  misc_feature 1..1910: note = mRNA product Design e-5 comprising derived and/or modified sequence from HRSV(A2)__F_DSCav1_mut3 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3314 - RNA, 1910 nt, synthetic construct
  misc_feature 1..1910: note = mRNA product Design e-5 comprising derived and/or modified sequence from HRSV(A2)__F_DSCav1_mut3 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3315 - RNA, 1910 nt, synthetic construct
  misc_feature 1..1910: note = mRNA product Design e-5 comprising derived and/or modified sequence from HRSV(A2)__F_DSCav1_mut3 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3316 - RNA, 1910 nt, synthetic construct
  misc_feature 1..1910: note = mRNA product Design e-5 comprising derived and/or modified sequence from HRSV(A2)__F_DSCav1_mut3 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3317 - RNA, 1910 nt, synthetic construct
  misc_feature 1..1910: note = mRNA product Design e-5 comprising derived and/or modified sequence from HRSV(A2)__F_DSCav1_mut3 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3318 - RNA, 1910 nt, synthetic construct
  misc_feature 1..1910: note = mRNA product Design e-5 comprising derived and/or modified sequence from HRSV(A2)__F_DSCav1_mut3 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3319 - RNA, 1910 nt, synthetic construct
  misc_feature 1..1910: note = mRNA product Design e-5 comprising derived and/or modified sequence from HRSV(A2)__F_DSCav1_mut3 (opt6)
  source 1..1910: mol_type = other RNA
gggagagcggctcggccattttgtcccagtcagtccggaggctgcggctgcagaagtaccgcctgcggagtaactgcaaagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3320 - RNA, 1910 nt, synthetic construct
  misc_feature 1..1910: note = mRNA product Design e-5 comprising derived and/or modified sequence from HRSV(A2)__F_DSCav1_mut3 (opt11)
  source 1..1910: mol_type = other RNA
gggagagcggctcggccattttgtcccagtcagtccggaggctgcggctgcagaagtaccgcctgcggagtaactgcaaagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3321 - RNA, 1977 nt, synthetic construct
  misc_feature 1..1977: note = mRNA product Design e-6 comprising derived and/or modified sequence from HRSV(A2)__F_DSCav1_mut3 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3322 - RNA, 1977 nt, synthetic construct
  misc_feature 1..1977: note = mRNA product Design e-6 comprising derived and/or modified sequence from HRSV(A2)__F_DSCav1_mut3 (opt1)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3323 - RNA, 1977 nt, synthetic construct
  misc_feature 1..1977: note = mRNA product Design e-6 comprising derived and/or modified sequence from HRSV(A2)__F_DSCav1_mut3 (opt2)
  source 1..1977: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3324 - RNA, 1977 nt, synthetic construct
  misc_feature 1..1977: note = mRNA product Design e-6 comprising derived and/or modified sequence from HRSV(A2)__F_DSCav1_mut3 (opt3)
  source 1..1977: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3325 - RNA, 1977 nt, synthetic construct
  misc_feature 1..1977: note = mRNA product Design e-6 comprising derived and/or modified sequence from HRSV(A2)__F_DSCav1_mut3 (opt4)
  source 1..1977: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3326 - RNA, 1977 nt, synthetic construct
  misc_feature 1..1977: note = mRNA product Design e-6 comprising derived and/or modified sequence from HRSV(A2)__F_DSCav1_mut3 (opt5)
  source 1..1977: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3327 - RNA, 1977 nt, synthetic construct
  misc_feature 1..1977: note = mRNA product Design e-6 comprising derived and/or modified sequence from HRSV(A2)__F_DSCav1_mut3 (opt6)
  source 1..1977: mol_type = other RNA
gggagagcggctcggccattttgtcccagtcagtccggaggctgcggctgcagaagtaccgcctgcggagtaactgcaaagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3328 - RNA, 1977 nt, synthetic construct
  misc_feature 1..1977: note = mRNA product Design e-6 comprising derived and/or modified sequence from HRSV(A2)__F_DSCav1_mut3 (opt11)
  source 1..1977: mol_type = other RNA
gggagagcggctcggccattttgtcccagtcagtccggaggctgcggctgcagaagtaccgcctgcggagtaactgcaaagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3329 - RNA, 2193 nt, synthetic construct
  misc_feature 1..2193: note = mRNA product Design f-1 comprising derived and/or modified sequence from HRSV(A2)__F_DSCav1_mut3 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3330 - RNA, 2193 nt, synthetic construct
  misc_feature 1..2193: note = mRNA product Design f-1 comprising derived and/or modified sequence from HRSV(A2)__F_DSCav1_mut3 (opt1)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3331 - RNA, 2193 nt, synthetic construct
  misc_feature 1..2193: note = mRNA product Design f-1 comprising derived and/or modified sequence from HRSV(A2)__F_DSCav1_mut3 (opt2)
  source 1..2193: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3332 - RNA, 2193 nt, synthetic construct
  misc_feature 1..2193: note = mRNA product Design f-1 comprising derived and/or modified sequence from HRSV(A2)__F_DSCav1_mut3 (opt3)
  source 1..2193: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3333 - RNA, 2193 nt, synthetic construct
  misc_feature 1..2193: note = mRNA product Design f-1 comprising derived and/or modified sequence from HRSV(A2)__F_DSCav1_mut3 (opt4)
  source 1..2193: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3334 - RNA, 2193 nt, synthetic construct
  misc_feature 1..2193: note = mRNA product Design f-1 comprising derived and/or modified sequence from HRSV(A2)__F_DSCav1_mut3 (opt5)
  source 1..2193: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3335 - RNA, 2193 nt, synthetic construct
  misc_feature 1..2193: note = mRNA product Design f-1 comprising derived and/or modified sequence from HRSV(A2)__F_DSCav1_mut3 (opt6)
  source 1..2193: mol_type = other RNA
gggagagcggctcggccattttgtcccagtcagtccggaggctgcggctgcagaagtaccgcctgcggagtaactgcaaagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3336 - RNA, 2193 nt, synthetic construct
  misc_feature 1..2193: note = mRNA product Design f-1 comprising derived and/or modified sequence from HRSV(A2)__F_DSCav1_mut3 (opt11)
  source 1..2193: mol_type = other RNA
gggagagcggctcggccattttgtcccagtcagtccggaggctgcggctgcagaagtaccgcctgcggagtaactgcaaagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3337 - RNA, 1973 nt, synthetic construct
  misc_feature 1..1973: note = mRNA product Design f-2 comprising derived and/or modified sequence from HRSV(A2)__F_DSCav1_mut3 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3338 - RNA, 1973 nt, synthetic construct
  misc_feature 1..1973: note = mRNA product Design f-2 comprising derived and/or modified sequence from HRSV(A2)__F_DSCav1_mut3 (opt1)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3339 - RNA, 1973 nt, synthetic construct
  misc_feature 1..1973: note = mRNA product Design f-2 comprising derived and/or modified sequence from HRSV(A2)__F_DSCav1_mut3 (opt2)
  source 1..1973: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3340 - RNA, 1973 nt, synthetic construct
  misc_feature 1..1973: note = mRNA product Design f-2 comprising derived and/or modified sequence from HRSV(A2)__F_DSCav1_mut3 (opt3)
  source 1..1973: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3341 - RNA, 1973 nt, synthetic construct
  misc_feature 1..1973: note = mRNA product Design f-2 comprising derived and/or modified sequence from HRSV(A2)__F_DSCav1_mut3 (opt4)
  source 1..1973: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3342 - RNA, 1973 nt, synthetic construct
  misc_feature 1..1973: note = mRNA product Design f-2 comprising derived and/or modified sequence from HRSV(A2)__F_DSCav1_mut3 (opt5)
  source 1..1973: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3343 - RNA, 1973 nt, synthetic construct
  misc_feature 1..1973: note = mRNA product Design f-2 comprising derived and/or modified sequence from HRSV(A2)__F_DSCav1_mut3 (opt6)
  source 1..1973: mol_type = other RNA
gggagagcggctcggccattttgtcccagtcagtccggaggctgcggctgcagaagtaccgcctgcggagtaactgcaaagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3344 - RNA, 1973 nt, synthetic construct
  misc_feature 1..1973: note = mRNA product Design f-2 comprising derived and/or modified sequence from HRSV(A2)__F_DSCav1_mut3 (opt11)
  source 1..1973: mol_type = other RNA
gggagagcggctcggccattttgtcccagtcagtccggaggctgcggctgcagaagtaccgcctgcggagtaactgcaaagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3345 - RNA, 1964 nt, synthetic construct
  misc_feature 1..1964: note = mRNA product Design f-3 comprising derived and/or modified sequence from HRSV(A2)__F_DSCav1_mut3 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3346 - RNA, 1964 nt, synthetic construct
  misc_feature 1..1964: note = mRNA product Design f-3 comprising derived and/or modified sequence from HRSV(A2)__F_DSCav1_mut3 (opt1)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3347 - RNA, 1964 nt, synthetic construct
  misc_feature 1..1964: note = mRNA product Design f-3 comprising derived and/or modified sequence from HRSV(A2)__F_DSCav1_mut3 (opt2)
  source 1..1964: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3348 - RNA, 1964 nt, synthetic construct
  misc_feature 1..1964: note = mRNA product Design f-3 comprising derived and/or modified sequence from HRSV(A2)__F_DSCav1_mut3 (opt3)
  source 1..1964: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3349 - RNA, 1964 nt, synthetic construct
  misc_feature 1..1964: note = mRNA product Design f-3 comprising derived and/or modified sequence from HRSV(A2)__F_DSCav1_mut3 (opt4)
  source 1..1964: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3350 - RNA, 1964 nt, synthetic construct
  misc_feature 1..1964: note = mRNA product Design f-3 comprising derived and/or modified sequence from HRSV(A2)__F_DSCav1_mut3 (opt5)
  source 1..1964: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3351 - RNA, 1964 nt, synthetic construct
  misc_feature 1..1964: note = mRNA product Design f-3 comprising derived and/or modified sequence from HRSV(A2)__F_DSCav1_mut3 (opt6)
  source 1..1964: mol_type = other RNA
gggagagtcccgcagtcggcgtccagcggctctgcttgttcgtgtgtgtgtcgttgcaggccttattcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3352 - RNA, 1964 nt, synthetic construct
  misc_feature 1..1964: note = mRNA product Design f-3 comprising derived and/or modified sequence from HRSV(A2)__F_DSCav1_mut3 (opt11)
  source 1..1964: mol_type = other RNA
gggagagtcccgcagtcggcgtccagcggctctgcttgttcgtgtgtgtgtcgttgcaggccttattcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3353 - RNA, 2180 nt, synthetic construct
  misc_feature 1..2180: note = mRNA product Design f-4 comprising derived and/or modified sequence from HRSV(A2)__F_DSCav1_mut3 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3354 - RNA, 2180 nt, synthetic construct
  misc_feature 1..2180: note = mRNA product Design f-4 comprising derived and/or modified sequence from HRSV(A2)__F_DSCav1_mut3 (opt1)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3355 - RNA, 2180 nt, synthetic construct
  misc_feature 1..2180: note = mRNA product Design f-4 comprising derived and/or modified sequence from HRSV(A2)__F_DSCav1_mut3 (opt2)
  source 1..2180: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3356 - RNA, 2180 nt, synthetic construct
  misc_feature 1..2180: note = mRNA product Design f-4 comprising derived and/or modified sequence from HRSV(A2)__F_DSCav1_mut3 (opt3)
  source 1..2180: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3357 - RNA, 2180 nt, synthetic construct
  misc_feature 1..2180: note = mRNA product Design f-4 comprising derived and/or modified sequence from HRSV(A2)__F_DSCav1_mut3 (opt4)
  source 1..2180: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3358 - RNA, 2180 nt, synthetic construct
  misc_feature 1..2180: note = mRNA product Design f-4 comprising derived and/or modified sequence from HRSV(A2)__F_DSCav1_mut3 (opt5)
  source 1..2180: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3359 - RNA, 2180 nt, synthetic construct
  misc_feature 1..2180: note = mRNA product Design f-4 comprising derived and/or modified sequence from HRSV(A2)__F_DSCav1_mut3 (opt6)
  source 1..2180: mol_type = other RNA
gggagagtcccgcagtcggcgtccagcggctctgcttgttcgtgtgtgtgtcgttgcaggccttattcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3360 - RNA, 2180 nt, synthetic construct
  misc_feature 1..2180: note = mRNA product Design f-4 comprising derived and/or modified sequence from HRSV(A2)__F_DSCav1_mut3 (opt11)
  source 1..2180: mol_type = other RNA
gggagagtcccgcagtcggcgtccagcggctctgcttgttcgtgtgtgtgtcgttgcaggccttattcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3361 - RNA, 1956 nt, synthetic construct
  misc_feature 1..1956: note = mRNA product Design f-5 comprising derived and/or modified sequence from HRSV(A2)__F_DSCav1_mut3 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3362 - RNA, 1956 nt, synthetic construct
  misc_feature 1..1956: note = mRNA product Design f-5 comprising derived and/or modified sequence from HRSV(A2)__F_DSCav1_mut3 (opt1)
  source 1..1956: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3363 - RNA, 1956 nt, synthetic construct
  misc_feature 1..1956: note = mRNA product Design f-5 comprising derived and/or modified sequence from HRSV(A2)__F_DSCav1_mut3 (opt2)
  source 1..1956: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3364 - RNA, 1956 nt, synthetic construct
  misc_feature 1..1956: note = mRNA product Design f-5 comprising derived and/or modified sequence from HRSV(A2)__F_DSCav1_mut3 (opt3)
  source 1..1956: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3365 - RNA, 1956 nt, synthetic construct
  misc_feature 1..1956: note = mRNA product Design f-5 comprising derived and/or modified sequence from HRSV(A2)__F_DSCav1_mut3 (opt4)
  source 1..1956: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3366 - RNA, 1956 nt, synthetic construct
  misc_feature 1..1956: note = mRNA product Design f-5 comprising derived and/or modified sequence from HRSV(A2)__F_DSCav1_mut3 (opt5)
  source 1..1956: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3367 - RNA, 1956 nt, synthetic construct
  misc_feature 1..1956: note = mRNA product Design f-5 comprising derived and/or modified sequence from HRSV(A2)__F_DSCav1_mut3 (opt6)
  source 1..1956: mol_type = other RNA
gggagactttcccattctgtagcagaatttggtgttgcctgtggtcttggtcccgcggagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3368 - RNA, 1956 nt, synthetic construct
  misc_feature 1..1956: note = mRNA product Design f-5 comprising derived and/or modified sequence from HRSV(A2)__F_DSCav1_mut3 (opt11)
  source 1..1956: mol_type = other RNA
gggagactttcccattctgtagcagaatttggtgttgcctgtggtcttggtcccgcggagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3369 - RNA, 1952 nt, synthetic construct
  misc_feature 1..1952: note = mRNA product Design g-1 comprising derived and/or modified sequence from HRSV(A2)__F_DSCav1_mut3 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3370 - RNA, 1952 nt, synthetic construct
  misc_feature 1..1952: note = mRNA product Design g-1 comprising derived and/or modified sequence from HRSV(A2)__F_DSCav1_mut3 (opt1)
  source 1..1952: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3371 - RNA, 1952 nt, synthetic construct
  misc_feature 1..1952: note = mRNA product Design g-1 comprising derived and/or modified sequence from HRSV(A2)__F_DSCav1_mut3 (opt2)
  source 1..1952: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3372 - RNA, 1952 nt, synthetic construct
  misc_feature 1..1952: note = mRNA product Design g-1 comprising derived and/or modified sequence from HRSV(A2)__F_DSCav1_mut3 (opt3)
  source 1..1952: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3373 - RNA, 1952 nt, synthetic construct
  misc_feature 1..1952: note = mRNA product Design g-1 comprising derived and/or modified sequence from HRSV(A2)__F_DSCav1_mut3 (opt4)
  source 1..1952: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3374 - RNA, 1952 nt, synthetic construct
  misc_feature 1..1952: note = mRNA product Design g-1 comprising derived and/or modified sequence from HRSV(A2)__F_DSCav1_mut3 (opt5)
  source 1..1952: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3375 - RNA, 1952 nt, synthetic construct
  misc_feature 1..1952: note = mRNA product Design g-1 comprising derived and/or modified sequence from HRSV(A2)__F_DSCav1_mut3 (opt6)
  source 1..1952: mol_type = other RNA
gggagactttcccattctgtagcagaatttggtgttgcctgtggtcttggtcccgcggagaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3376 - RNA, 1952 nt, synthetic construct
  misc_feature 1..1952: note = mRNA product Design g-1 comprising derived and/or modified sequence from HRSV(A2)__F_DSCav1_mut3 (opt11)
  source 1..1952: mol_type = other RNA
gggagactttcccattctgtagcagaatttggtgttgcctgtggtcttggtcccgcggagaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3377 - RNA, 1967 nt, synthetic construct
  misc_feature 1..1967: note = mRNA product Design g-2 comprising derived and/or modified sequence from HRSV(A2)__F_DSCav1_mut3 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3378 - RNA, 1967 nt, synthetic construct
  misc_feature 1..1967: note = mRNA product Design g-2 comprising derived and/or modified sequence from HRSV(A2)__F_DSCav1_mut3 (opt1)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3379 - RNA, 1967 nt, synthetic construct
  misc_feature 1..1967: note = mRNA product Design g-2 comprising derived and/or modified sequence from HRSV(A2)__F_DSCav1_mut3 (opt2)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3380 - RNA, 1967 nt, synthetic construct
  misc_feature 1..1967: note = mRNA product Design g-2 comprising derived and/or modified sequence from HRSV(A2)__F_DSCav1_mut3 (opt3)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3381 - RNA, 1967 nt, synthetic construct
  misc_feature 1..1967: note = mRNA product Design g-2 comprising derived and/or modified sequence from HRSV(A2)__F_DSCav1_mut3 (opt4)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3382 - RNA, 1967 nt, synthetic construct
  misc_feature 1..1967: note = mRNA product Design g-2 comprising derived and/or modified sequence from HRSV(A2)__F_DSCav1_mut3 (opt5)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3383 - RNA, 1967 nt, synthetic construct
  misc_feature 1..1967: note = mRNA product Design g-2 comprising derived and/or modified sequence from HRSV(A2)__F_DSCav1_mut3 (opt6)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3384 - RNA, 1967 nt, synthetic construct
  misc_feature 1..1967: note = mRNA product Design g-2 comprising derived and/or modified sequence from HRSV(A2)__F_DSCav1_mut3 (opt11)
  source 1..1967: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3385 - RNA, 2199 nt, synthetic construct
  misc_feature 1..2199: note = mRNA product Design g-3 comprising derived and/or modified sequence from HRSV(A2)__F_DSCav1_mut3 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3386 - RNA, 2199 nt, synthetic construct
  misc_feature 1..2199: note = mRNA product Design g-3 comprising derived and/or modified sequence from HRSV(A2)__F_DSCav1_mut3 (opt1)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3387 - RNA, 2199 nt, synthetic construct
  misc_feature 1..2199: note = mRNA product Design g-3 comprising derived and/or modified sequence from HRSV(A2)__F_DSCav1_mut3 (opt2)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3388 - RNA, 2199 nt, synthetic construct
  misc_feature 1..2199: note = mRNA product Design g-3 comprising derived and/or modified sequence from HRSV(A2)__F_DSCav1_mut3 (opt3)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3389 - RNA, 2199 nt, synthetic construct
  misc_feature 1..2199: note = mRNA product Design g-3 comprising derived and/or modified sequence from HRSV(A2)__F_DSCav1_mut3 (opt4)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3390 - RNA, 2199 nt, synthetic construct
  misc_feature 1..2199: note = mRNA product Design g-3 comprising derived and/or modified sequence from HRSV(A2)__F_DSCav1_mut3 (opt5)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3391 - RNA, 2199 nt, synthetic construct
  misc_feature 1..2199: note = mRNA product Design g-3 comprising derived and/or modified sequence from HRSV(A2)__F_DSCav1_mut3 (opt6)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3392 - RNA, 2199 nt, synthetic construct
  misc_feature 1..2199: note = mRNA product Design g-3 comprising derived and/or modified sequence from HRSV(A2)__F_DSCav1_mut3 (opt11)
  source 1..2199: mol_type = other RNA
gggagagtccgctcagccaggttgcagaagcggcttagcgtgtgtcctaatcttctctctgcgtgtaggtaggcctgtgccgcaaacaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3393 - RNA, 1994 nt, synthetic construct
  misc_feature 1..1994: note = mRNA product Design g-4 comprising derived and/or modified sequence from HRSV(A2)__F_DSCav1_mut3 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3394 - RNA, 1994 nt, synthetic construct
  misc_feature 1..1994: note = mRNA product Design g-4 comprising derived and/or modified sequence from HRSV(A2)__F_DSCav1_mut3 (opt1)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3395 - RNA, 1994 nt, synthetic construct
  misc_feature 1..1994: note = mRNA product Design g-4 comprising derived and/or modified sequence from HRSV(A2)__F_DSCav1_mut3 (opt2)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3396 - RNA, 1994 nt, synthetic construct
  misc_feature 1..1994: note = mRNA product Design g-4 comprising derived and/or modified sequence from HRSV(A2)__F_DSCav1_mut3 (opt3)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3397 - RNA, 1994 nt, synthetic construct
  misc_feature 1..1994: note = mRNA product Design g-4 comprising derived and/or modified sequence from HRSV(A2)__F_DSCav1_mut3 (opt4)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3398 - RNA, 1994 nt, synthetic construct
  misc_feature 1..1994: note = mRNA product Design g-4 comprising derived and/or modified sequence from HRSV(A2)__F_DSCav1_mut3 (opt5)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3399 - RNA, 1994 nt, synthetic construct
  misc_feature 1..1994: note = mRNA product Design g-4 comprising derived and/or modified sequence from HRSV(A2)__F_DSCav1_mut3 (opt6)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3400 - RNA, 1994 nt, synthetic construct
  misc_feature 1..1994: note = mRNA product Design g-4 comprising derived and/or modified sequence from HRSV(A2)__F_DSCav1_mut3 (opt11)
  source 1..1994: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3401 - RNA, 1970 nt, synthetic construct
  misc_feature 1..1970: note = mRNA product Design g-5 comprising derived and/or modified sequence from HRSV(A2)__F_DSCav1_mut3 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3402 - RNA, 1970 nt, synthetic construct
  misc_feature 1..1970: note = mRNA product Design g-5 comprising derived and/or modified sequence from HRSV(A2)__F_DSCav1_mut3 (opt1)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3403 - RNA, 1970 nt, synthetic construct
  misc_feature 1..1970: note = mRNA product Design g-5 comprising derived and/or modified sequence from HRSV(A2)__F_DSCav1_mut3 (opt2)
  source 1..1970: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3404 - RNA, 1970 nt, synthetic construct
  misc_feature 1..1970: note = mRNA product Design g-5 comprising derived and/or modified sequence from HRSV(A2)__F_DSCav1_mut3 (opt3)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3405 - RNA, 1970 nt, synthetic construct
  misc_feature 1..1970: note = mRNA product Design g-5 comprising derived and/or modified sequence from HRSV(A2)__F_DSCav1_mut3 (opt4)
  source 1..1970: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3406 - RNA, 1970 nt, synthetic construct
  misc_feature 1..1970: note = mRNA product Design g-5 comprising derived and/or modified sequence from HRSV(A2)__F_DSCav1_mut3 (opt5)
  source 1..1970: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3407 - RNA, 1970 nt, synthetic construct
  misc_feature 1..1970: note = mRNA product Design g-5 comprising derived and/or modified sequence from HRSV(A2)__F_DSCav1_mut3 (opt6)
  source 1..1970: mol_type = other RNA
gggagacccgtgacccggaagttgtacggctacgcgactttccctcccacaaaccctcgcgcccttcctttcctacttgggcccggcagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3408 - RNA, 1970 nt, synthetic construct
  misc_feature 1..1970: note = mRNA product Design g-5 comprising derived and/or modified sequence from HRSV(A2)__F_DSCav1_mut3 (opt11)
  source 1..1970: mol_type = other RNA
gggagacccgtgacccggaagttgtacggctacgcgactttccctcccacaaaccctcgcgcccttcctttcctacttgggcccggcagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3409 - RNA, 1986 nt, synthetic construct
  misc_feature 1..1986: note = mRNA product Design h-1 comprising derived and/or modified sequence from HRSV(A2)__F_DSCav1_mut3 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3410 - RNA, 1986 nt, synthetic construct
  misc_feature 1..1986: note = mRNA product Design h-1 comprising derived and/or modified sequence from HRSV(A2)__F_DSCav1_mut3 (opt1)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3411 - RNA, 1986 nt, synthetic construct
  misc_feature 1..1986: note = mRNA product Design h-1 comprising derived and/or modified sequence from HRSV(A2)__F_DSCav1_mut3 (opt2)
  source 1..1986: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3412 - RNA, 1986 nt, synthetic construct
  misc_feature 1..1986: note = mRNA product Design h-1 comprising derived and/or modified sequence from HRSV(A2)__F_DSCav1_mut3 (opt3)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3413 - RNA, 1986 nt, synthetic construct
  misc_feature 1..1986: note = mRNA product Design h-1 comprising derived and/or modified sequence from HRSV(A2)__F_DSCav1_mut3 (opt4)
  source 1..1986: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3414 - RNA, 1986 nt, synthetic construct
  misc_feature 1..1986: note = mRNA product Design h-1 comprising derived and/or modified sequence from HRSV(A2)__F_DSCav1_mut3 (opt5)
  source 1..1986: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3415 - RNA, 1986 nt, synthetic construct
  misc_feature 1..1986: note = mRNA product Design h-1 comprising derived and/or modified sequence from HRSV(A2)__F_DSCav1_mut3 (opt6)
  source 1..1986: mol_type = other RNA
gggagacccgtgacccggaagttgtacggctacgcgactttccctcccacaaaccctcgcgcccttcctttcctacttgggcccggcagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3416 - RNA, 1986 nt, synthetic construct
  misc_feature 1..1986: note = mRNA product Design h-1 comprising derived and/or modified sequence from HRSV(A2)__F_DSCav1_mut3 (opt11)
  source 1..1986: mol_type = other RNA
gggagacccgtgacccggaagttgtacggctacgcgactttccctcccacaaaccctcgcgcccttcctttcctacttgggcccggcagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3417 - RNA, 2202 nt, synthetic construct
  misc_feature 1..2202: note = mRNA product Design h-2 comprising derived and/or modified sequence from HRSV(A2)__F_DSCav1_mut3 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3418 - RNA, 2202 nt, synthetic construct
  misc_feature 1..2202: note = mRNA product Design h-2 comprising derived and/or modified sequence from HRSV(A2)__F_DSCav1_mut3 (opt1)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3419 - RNA, 2202 nt, synthetic construct
  misc_feature 1..2202: note = mRNA product Design h-2 comprising derived and/or modified sequence from HRSV(A2)__F_DSCav1_mut3 (opt2)
  source 1..2202: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3420 - RNA, 2202 nt, synthetic construct
  misc_feature 1..2202: note = mRNA product Design h-2 comprising derived and/or modified sequence from HRSV(A2)__F_DSCav1_mut3 (opt3)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3421 - RNA, 2202 nt, synthetic construct
  misc_feature 1..2202: note = mRNA product Design h-2 comprising derived and/or modified sequence from HRSV(A2)__F_DSCav1_mut3 (opt4)
  source 1..2202: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3422 - RNA, 2202 nt, synthetic construct
  misc_feature 1..2202: note = mRNA product Design h-2 comprising derived and/or modified sequence from HRSV(A2)__F_DSCav1_mut3 (opt5)
  source 1..2202: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3423 - RNA, 2202 nt, synthetic construct
  misc_feature 1..2202: note = mRNA product Design h-2 comprising derived and/or modified sequence from HRSV(A2)__F_DSCav1_mut3 (opt6)
  source 1..2202: mol_type = other RNA
gggagacccgtgacccggaagttgtacggctacgcgactttccctcccacaaaccctcgcgcccttcctttcctacttgggcccggcagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3424 - RNA, 2202 nt, synthetic construct
  misc_feature 1..2202: note = mRNA product Design h-2 comprising derived and/or modified sequence from HRSV(A2)__F_DSCav1_mut3 (opt11)
  source 1..2202: mol_type = other RNA
gggagacccgtgacccggaagttgtacggctacgcgactttccctcccacaaaccctcgcgcccttcctttcctacttgggcccggcagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3425 - RNA, 1982 nt, synthetic construct
  misc_feature 1..1982: note = mRNA product Design h-3 comprising derived and/or modified sequence from HRSV(A2)__F_DSCav1_mut3 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3426 - RNA, 1982 nt, synthetic construct
  misc_feature 1..1982: note = mRNA product Design h-3 comprising derived and/or modified sequence from HRSV(A2)__F_DSCav1_mut3 (opt1)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3427 - RNA, 1982 nt, synthetic construct
  misc_feature 1..1982: note = mRNA product Design h-3 comprising derived and/or modified sequence from HRSV(A2)__F_DSCav1_mut3 (opt2)
  source 1..1982: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3428 - RNA, 1982 nt, synthetic construct
  misc_feature 1..1982: note = mRNA product Design h-3 comprising derived and/or modified sequence from HRSV(A2)__F_DSCav1_mut3 (opt3)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3429 - RNA, 1982 nt, synthetic construct
  misc_feature 1..1982: note = mRNA product Design h-3 comprising derived and/or modified sequence from HRSV(A2)__F_DSCav1_mut3 (opt4)
  source 1..1982: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3430 - RNA, 1982 nt, synthetic construct
  misc_feature 1..1982: note = mRNA product Design h-3 comprising derived and/or modified sequence from HRSV(A2)__F_DSCav1_mut3 (opt5)
  source 1..1982: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3431 - RNA, 1982 nt, synthetic construct
  misc_feature 1..1982: note = mRNA product Design h-3 comprising derived and/or modified sequence from HRSV(A2)__F_DSCav1_mut3 (opt6)
  source 1..1982: mol_type = other RNA
gggagacccgtgacccggaagttgtacggctacgcgactttccctcccacaaaccctcgcgcccttcctttcctacttgggcccggcagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3432 - RNA, 1982 nt, synthetic construct
  misc_feature 1..1982: note = mRNA product Design h-3 comprising derived and/or modified sequence from HRSV(A2)__F_DSCav1_mut3 (opt11)
  source 1..1982: mol_type = other RNA
gggagacccgtgacccggaagttgtacggctacgcgactttccctcccacaaaccctcgcgcccttcctttcctacttgggcccggcagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3433 - RNA, 2045 nt, synthetic construct
  misc_feature 1..2045: note = mRNA product Design h-4 comprising derived and/or modified sequence from HRSV(A2)__F_DSCav1_mut3 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3434 - RNA, 2045 nt, synthetic construct
  misc_feature 1..2045: note = mRNA product Design h-4 comprising derived and/or modified sequence from HRSV(A2)__F_DSCav1_mut3 (opt1)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3435 - RNA, 2045 nt, synthetic construct
  misc_feature 1..2045: note = mRNA product Design h-4 comprising derived and/or modified sequence from HRSV(A2)__F_DSCav1_mut3 (opt2)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3436 - RNA, 2045 nt, synthetic construct
  misc_feature 1..2045: note = mRNA product Design h-4 comprising derived and/or modified sequence from HRSV(A2)__F_DSCav1_mut3 (opt3)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3437 - RNA, 2045 nt, synthetic construct
  misc_feature 1..2045: note = mRNA product Design h-4 comprising derived and/or modified sequence from HRSV(A2)__F_DSCav1_mut3 (opt4)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3438 - RNA, 2045 nt, synthetic construct
  misc_feature 1..2045: note = mRNA product Design h-4 comprising derived and/or modified sequence from HRSV(A2)__F_DSCav1_mut3 (opt5)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3439 - RNA, 2045 nt, synthetic construct
  misc_feature 1..2045: note = mRNA product Design h-4 comprising derived and/or modified sequence from HRSV(A2)__F_DSCav1_mut3 (opt6)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3440 - RNA, 2045 nt, synthetic construct
  misc_feature 1..2045: note = mRNA product Design h-4 comprising derived and/or modified sequence from HRSV(A2)__F_DSCav1_mut3 (opt11)
  source 1..2045: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3441 - RNA, 2061 nt, synthetic construct
  misc_feature 1..2061: note = mRNA product Design h-5 comprising derived and/or modified sequence from HRSV(A2)__F_DSCav1_mut3 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3442 - RNA, 2061 nt, synthetic construct
  misc_feature 1..2061: note = mRNA product Design h-5 comprising derived and/or modified sequence from HRSV(A2)__F_DSCav1_mut3 (opt1)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3443 - RNA, 2061 nt, synthetic construct
  misc_feature 1..2061: note = mRNA product Design h-5 comprising derived and/or modified sequence from HRSV(A2)__F_DSCav1_mut3 (opt2)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3444 - RNA, 2061 nt, synthetic construct
  misc_feature 1..2061: note = mRNA product Design h-5 comprising derived and/or modified sequence from HRSV(A2)__F_DSCav1_mut3 (opt3)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3445 - RNA, 2061 nt, synthetic construct
  misc_feature 1..2061: note = mRNA product Design h-5 comprising derived and/or modified sequence from HRSV(A2)__F_DSCav1_mut3 (opt4)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3446 - RNA, 2061 nt, synthetic construct
  misc_feature 1..2061: note = mRNA product Design h-5 comprising derived and/or modified sequence from HRSV(A2)__F_DSCav1_mut3 (opt5)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3447 - RNA, 2061 nt, synthetic construct
  misc_feature 1..2061: note = mRNA product Design h-5 comprising derived and/or modified sequence from HRSV(A2)__F_DSCav1_mut3 (opt6)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3448 - RNA, 2061 nt, synthetic construct
  misc_feature 1..2061: note = mRNA product Design h-5 comprising derived and/or modified sequence from HRSV(A2)__F_DSCav1_mut3 (opt11)
  source 1..2061: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3449 - RNA, 1994 nt, synthetic construct
  misc_feature 1..1994: note = mRNA product Design i-1 comprising derived and/or modified sequence from HRSV(A2)__F_DSCav1_mut3 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3450 - RNA, 1994 nt, synthetic construct
  misc_feature 1..1994: note = mRNA product Design i-1 comprising derived and/or modified sequence from HRSV(A2)__F_DSCav1_mut3 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3451 - RNA, 1994 nt, synthetic construct
  misc_feature 1..1994: note = mRNA product Design i-1 comprising derived and/or modified sequence from HRSV(A2)__F_DSCav1_mut3 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3452 - RNA, 1994 nt, synthetic construct
  misc_feature 1..1994: note = mRNA product Design i-1 comprising derived and/or modified sequence from HRSV(A2)__F_DSCav1_mut3 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3453 - RNA, 1994 nt, synthetic construct
  misc_feature 1..1994: note = mRNA product Design i-1 comprising derived and/or modified sequence from HRSV(A2)__F_DSCav1_mut3 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3454 - RNA, 1994 nt, synthetic construct
  misc_feature 1..1994: note = mRNA product Design i-1 comprising derived and/or modified sequence from HRSV(A2)__F_DSCav1_mut3 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3455 - RNA, 1994 nt, synthetic construct
  misc_feature 1..1994: note = mRNA product Design i-1 comprising derived and/or modified sequence from HRSV(A2)__F_DSCav1_mut3 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3456 - RNA, 1994 nt, synthetic construct
  misc_feature 1..1994: note = mRNA product Design i-1 comprising derived and/or modified sequence from HRSV(A2)__F_DSCav1_mut3 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3457 - RNA, 1994 nt, synthetic construct
  misc_feature 1..1994: note = mRNA product Design i-2 comprising derived and/or modified sequence from HRSV(A2)__F_DSCav1_mut3 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3458 - RNA, 1994 nt, synthetic construct
  misc_feature 1..1994: note = mRNA product Design i-2 comprising derived and/or modified sequence from HRSV(A2)__F_DSCav1_mut3 (opt1)
  source 1..1994: mol_type = other RNA
gggagaggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3459 - RNA, 1994 nt, synthetic construct
  misc_feature 1..1994: note = mRNA product Design i-2 comprising derived and/or modified sequence from HRSV(A2)__F_DSCav1_mut3 (opt2)
  source 1..1994: mol_type = other RNA
gggagaggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3460 - RNA, 1994 nt, synthetic construct
  misc_feature 1..1994: note = mRNA product Design i-2 comprising derived and/or modified sequence from HRSV(A2)__F_DSCav1_mut3 (opt3)
  source 1..1994: mol_type = other RNA
gggagaggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3461 - RNA, 1994 nt, synthetic construct
  misc_feature 1..1994: note = mRNA product Design i-2 comprising derived and/or modified sequence from HRSV(A2)__F_DSCav1_mut3 (opt4)
  source 1..1994: mol_type = other RNA
gggagaggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3462 - RNA, 1994 nt, synthetic construct
  misc_feature 1..1994: note = mRNA product Design i-2 comprising derived and/or modified sequence from HRSV(A2)__F_DSCav1_mut3 (opt5)
  source 1..1994: mol_type = other RNA
gggagaggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3463 - RNA, 1994 nt, synthetic construct
  misc_feature 1..1994: note = mRNA product Design i-2 comprising derived and/or modified sequence from HRSV(A2)__F_DSCav1_mut3 (opt6)
  source 1..1994: mol_type = other RNA
gggagaggcgctgcctacggaggtggcagccatctccttctcggcatcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3464 - RNA, 1994 nt, synthetic construct
  misc_feature 1..1994: note = mRNA product Design i-2 comprising derived and/or modified sequence from HRSV(A2)__F_DSCav1_mut3 (opt11)
  source 1..1994: mol_type = other RNA
gggagaggcgctgcctacggaggtggcagccatctccttctcggcatcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3465 - RNA, 1990 nt, synthetic construct
  misc_feature 1..1990: note = mRNA product Design i-2 comprising derived and/or modified sequence from HRSV(A2)__F_DSCav1_mut3 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3466 - RNA, 1990 nt, synthetic construct
  misc_feature 1..1990: note = mRNA product Design i-2 comprising derived and/or modified sequence from HRSV(A2)__F_DSCav1_mut3 (opt1)
  source 1..1990: mol_type = other RNA
ggggcgctgcctacggaggtggcagccatctccttctcggcatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3467 - RNA, 1990 nt, synthetic construct
  misc_feature 1..1990: note = mRNA product Design i-2 comprising derived and/or modified sequence from HRSV(A2)__F_DSCav1_mut3 (opt2)
  source 1..1990: mol_type = other RNA
ggggcgctgcctacggaggtggcagccatctccttctcggcatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3468 - RNA, 1990 nt, synthetic construct
  misc_feature 1..1990: note = mRNA product Design i-2 comprising derived and/or modified sequence from HRSV(A2)__F_DSCav1_mut3 (opt3)
  source 1..1990: mol_type = other RNA
ggggcgctgcctacggaggtggcagccatctccttctcggcatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3469 - RNA, 1990 nt, synthetic construct
  misc_feature 1..1990: note = mRNA product Design i-2 comprising derived and/or modified sequence from HRSV(A2)__F_DSCav1_mut3 (opt4)
  source 1..1990: mol_type = other RNA
ggggcgctgcctacggaggtggcagccatctccttctcggcatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3470 - RNA, 1990 nt, synthetic construct
  misc_feature 1..1990: note = mRNA product Design i-2 comprising derived and/or modified sequence from HRSV(A2)__F_DSCav1_mut3 (opt5)
  source 1..1990: mol_type = other RNA
ggggcgctgcctacggaggtggcagccatctccttctcggcatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3471 - RNA, 1990 nt, synthetic construct
  misc_feature 1..1990: note = mRNA product Design i-2 comprising derived and/or modified sequence from HRSV(A2)__F_DSCav1_mut3 (opt6)
  source 1..1990: mol_type = other RNA
ggggcgctgcctacggaggtggcagccatctccttctcggcatcaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3472 - RNA, 1990 nt, synthetic construct
  misc_feature 1..1990: note = mRNA product Design i-2 comprising derived and/or modified sequence from HRSV(A2)__F_DSCav1_mut3 (opt11)
  source 1..1990: mol_type = other RNA
ggggcgctgcctacggaggtggcagccatctccttctcggcatcaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3473 - RNA, 1825 nt, synthetic construct
  misc_feature 1..1825: note = mRNA product Design i-3 comprising derived and/or modified sequence from HRSV(A2)__F_DSCav1_mut3 (opt1) R6770
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggagcacgcccgtcaccctgtccaaggaccagctgagcggcatcaacaacatcgcgttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3474 - RNA, 1825 nt, synthetic construct
  misc_feature 1..1825: note = mRNA product Design i-3 comprising derived and/or modified sequence from HRSV(A2)__F_DSCav1_mut3 (opt1)
  source 1..1825: mol_type = other RNA
gggagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtccacccccgtgaccctgagcaaggaccagctctccggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3475 - RNA, 1825 nt, synthetic construct
  misc_feature 1..1825: note = mRNA product Design i-3 comprising derived and/or modified sequence from HRSV(A2)__F_DSCav1_mut3 (opt2)
  source 1..1825: mol_type = other RNA
gggagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctccacccccgtcaccctctccaaggaccagctctccggcatcaacaacatcgccttctccaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3476 - RNA, 1825 nt, synthetic construct
  misc_feature 1..1825: note = mRNA product Design i-3 comprising derived and/or modified sequence from HRSV(A2)__F_DSCav1_mut3 (opt3)
  source 1..1825: mol_type = other RNA
gggagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctcaacacccgtgaccctgagtaaagatcaactctctgggatcaataacattgcattcagcaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3477 - RNA, 1825 nt, synthetic construct
  misc_feature 1..1825: note = mRNA product Design i-3 comprising derived and/or modified sequence from HRSV(A2)__F_DSCav1_mut3 (opt4)
  source 1..1825: mol_type = other RNA
gggagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagaagcacccccgtgaccctgagcaaggaccagctgagcggcatcaacaacatcgccttcagcaactgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3478 - RNA, 1825 nt, synthetic construct
  misc_feature 1..1825: note = mRNA product Design i-3 comprising derived and/or modified sequence from HRSV(A2)__F_DSCav1_mut3 (opt5)
  source 1..1825: mol_type = other RNA
gggagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagaagcacacccgtgaccctttctaaagatcaactctccggaatcaataacatcgctttcagcaattgaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3479 - RNA, 1825 nt, synthetic construct
  misc_feature 1..1825: note = mRNA product Design i-3 comprising derived and/or modified sequence from HRSV(A2)__F_DSCav1_mut3 (opt6)
  source 1..1825: mol_type = other RNA
gggagaaagcttaccatggaattactcatactaaaagccaatgccataaccactattctaacagcagtaacattctgtttcgcctcaggacaaaacataacagaagaattttatcaatccacctgttccgcagtctcgaaaggctaccttggcgcactaagaaccggatggtatacatcagtaataaccattgaactatcaaatatcaaagaaataaaatgcaacggaactgacgcaaaagtcaaactaataaaacaagaattagacaaatacaaaaacgccgttacagacttacaactactaatgcaatcaactccagcaacaggatcaggatctgctatatgctcaggtgtcgccgtatgtaaagtgttacacctcgaaggcgaagtaaacaaaataaaatcagcactactatccacaaataaagcagtagtatcactatccaatggtgtatcagtactcacattcaaagtactagacttaaaaaattatatagataaacaattactaccaatattaaacaaacaatcatgctcaataccaaacatagaaaccgtcattgaatttcaacaaaaaaacaatcgacttcttgaaataacacgagaattttcagtaaatgccggagtaacaaccccagtctcaacatacatgttaaccaactctgaactcctaagcctaatcaacgacatgcccataactaacgaccaaaaaaaactaatgtccaataatgtccaaatagtaagacaacaatcctactcaataatgtgcattataaaagaagaagtcctcgcctatgtagtacaactacccttatacggagtaattgacacaccatgttggaaactacatacatcaccactatgcaccactaacacaaaagaaggctccaacatatgcctaacccgaacagatcgcggatggtattgcgacaacgcaggaagtgtatccttctttccacaagcagaaacatgcaaagtacaatccaacagagtattctgtgacaccatgaactctctaacactaccttccgaagtaaatttatgcaacgtagacatatttaatcccaaatacgactgtaaaataatgacctcaaaaactgatgtctcatcatcagtcattacatcactcggagcaatagtcagttgctatggaaaaaccaaatgcacagctagtaacaaaaacaggggtataataaaaacattttcaaacggatgcgattacgtatcaaataaaggagtagacaccgtatccgtaggaaatactctctactgcgtaaacaaacaagaaggacaatccctatacgtaaaaggcgaaccaatcattaacttttacgacccacttgtatttccatcagacgaatttgatgcctcaatatcccaagtcaatgaaaaaataaaccaaagtctagcattcatccgaaaatcagatgaacttttacacaacgtaaacgccggaaaatcaacaacaaacatcatgatcacaacaatcatcatagtaataatagttatactactttccttaatagcagtcggcctactactctactgcaaagcacgatccacaccagtaaccttatctaaagaccaactctcaggcataaacaacatagcattctcaaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3480 - RNA, 1825 nt, synthetic construct
  misc_feature 1..1825: note = mRNA product Design i-3 comprising derived and/or modified sequence from HRSV(A2)__F_DSCav1_mut3 (opt11)
  source 1..1825: mol_type = other RNA
gggagaaagcttaccatggaactcctcatccttaaagcaaacgccatcacaaccatcctcacagcagtcactttctgcttcgcatccggacaaaacatcacagaagagttctatcaatccacgtgctccgcagtttccaaaggataccttggagccttacgaaccggctggtacacctccgtcatcaccatagaactcagcaacatcaaagaaatcaaatgcaacggaaccgacgcaaaagtcaaactcatcaaacaagaactagacaaatacaaaaacgcagtcaccgacctccaactactcatgcaatcaacccccgcaaccggctccggctccgccatctgctccggagtagccgtatgcaaagtcctccacctcgaaggcgaagttaacaagatcaagtccgcactcctatcaaccaacaaagcagtcgtctccctatccaacggcgtctccgtattaacattcaaagtcctcgacctcaaaaactacatagacaaacagctactccccatcctaaacaaacaatcctgctccatccccaacatcgaaactgtcatcgagttccaacagaaaaacaaccgcctcctagaaatcacccgagagttctccgtaaacgccggcgtcactacccccgtctctacctatatgctaaccaactctgaactcctatccctaatcaacgatatgcccataactaacgaccaaaagaaacttatgtccaacaacgtacaaatagtccggcaacaatcatactctatcatgtgcatcatcaaagaagaagtacttgcctacgttgtccaactcccactatacggcgtcatagacactccatgctggaaacttcacacctcacccctctgcaccactaacactaaagaaggctctaacatctgccttacccgcaccgaccgcggatggtactgcgacaacgcaggctcagttagcttcttcccacaagccgaaacctgcaaagtccagtcaaaccgtgtcttctgcgataccatgaactcgctcaccctcccttccgaagtcaacctctgcaacgtcgacatcttcaaccccaaatacgactgcaaaatcatgacctcaaaaaccgacgtatcttcttccgtcatcacctccctcggcgccatcgtatcctgctacggcaaaaccaaatgcactgcatcaaacaaaaaccgaggcatcatcaaaaccttctcgaacggatgcgactacgtatccaacaagggcgtcgacacagtctccgttggtaacaccctctactgcgtcaacaaacaagaaggccaatccctatacgtaaaaggcgaacccatcatcaacttctacgaccccctcgtcttccccagtgacgaatttgacgcctccatctcccaagtcaacgaaaagatcaaccaatcccttgccttcatacgcaaatccgacgaactcctacacaacgttaacgccggaaaatcaacaaccaacatcatgatcacaaccatcataatcgtcataatcgtcatactcctctccctcatagccgtcggcctgctattgtactgtaaagcccgctccacaccagtcacactttcaaaagaccaactctccgggatcaacaacatcgccttctccaactaaggactagttataagactgactagcccgatgggcctcccaacgggccctcctcccctccttgcaccgagattaataaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3481 - protein, 514 aa, synthetic construct
  REGION 1..514: note = derived and/or modified protein sequence (artificial) from HRSV(A2)__F-del_DSCav1_mut3
MELLILKANAITTILTAVTFCFASGQNITEEFYQSTCSAVSKGYLGALRTGWYTSVITIELSNIKEIKCNGTDAKVKLIKQELDKYKNAVTDLQLLMQSTPATGSGSAICSGVAVCKVLHLEGEVNKIKSALLSTNKAVVSLSNGVSVLTFKVLDLKNYIDKQLLPILNKQSCSIPNIETVIEFQQKNNRLLEITREFSVNAGVTTPVSTYMLTNSELLSLINDMPITNDQKKLMSNNVQIVRQQSYSIMCIIKEEVLAYVVQLPLYGVIDTPCWKLHTSPLCTTNTKEGSNICLTRTDRGWYCDNAGSVSFFPQAETCKVQSNRVFCDTMNSLTLPSEVNLCNVDIFNPKYDCKIMTSKTDVSSSVITSLGAIVSCYGKTKCTASNKNRGIIKTFSNGCDYVSNKGVDTVSVGNTLYCVNKQEGQSLYVKGEPIINFYDPLVFPSDEFDASISQVNEKINQSLAFIRKSDELLHNVNAGKSTTNIMITTIIIVIIVILLSLIAVGLLLYCKAR

SEQ ID NO: 3482 - RNA, 1545 nt, synthetic construct
  misc_feature 1..1545: note = derived and/or modified CDS sequence (opt1) from HRSV(A2)__F-del_DSCav1_mut3
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtga

SEQ ID NO: 3483 - RNA, 1545 nt, synthetic construct
  misc_feature 1..1545: note = derived and/or modified CDS sequence (opt1) from HRSV(A2)__F-del_DSCav1_mut3
  source 1..1545: mol_type = other RNA
atggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtga

SEQ ID NO: 3484 - RNA, 1545 nt, synthetic construct
  misc_feature 1..1545: note = derived and/or modified CDS sequence (opt2) from HRSV(A2)__F-del_DSCav1_mut3
  source 1..1545: mol_type = other RNA
atggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctga

SEQ ID NO: 3485 - RNA, 1545 nt, synthetic construct
  misc_feature 1..1545: note = derived and/or modified CDS sequence (opt3) from HRSV(A2)__F-del_DSCav1_mut3
  source 1..1545: mol_type = other RNA
atggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctga

SEQ ID NO: 3486 - RNA, 1545 nt, synthetic construct
  misc_feature 1..1545: note = derived and/or modified CDS sequence (opt4) from HRSV(A2)__F-del_DSCav1_mut3
  source 1..1545: mol_type = other RNA
atggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatga

SEQ ID NO: 3487 - RNA, 1545 nt, synthetic construct
  misc_feature 1..1545: note = derived and/or modified CDS sequence (opt5) from HRSV(A2)__F-del_DSCav1_mut3
  source 1..1545: mol_type = other RNA
atggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatga

SEQ ID NO: 3488 - RNA, 1545 nt, synthetic construct
  misc_feature 1..1545: note = derived and/or modified CDS sequence (opt6) from HRSV(A2)__F-del_DSCav1_mut3
  source 1..1545: mol_type = other RNA
atggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataa

SEQ ID NO: 3489 - RNA, 1545 nt, synthetic construct
  misc_feature 1..1545: note = derived and/or modified CDS sequence (opt11) from HRSV(A2)__F-del_DSCav1_mut3
  source 1..1545: mol_type = other RNA
atggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataa

SEQ ID NO: 3490 - RNA, 1821 nt, synthetic construct
  misc_feature 1..1821: note = mRNA product Design a-1 comprising derived and/or modified sequence from HRSV(A2)__F-del_DSCav1_mut3 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3491 - RNA, 1821 nt, synthetic construct
  misc_feature 1..1821: note = mRNA product Design a-1 comprising derived and/or modified sequence from HRSV(A2)__F-del_DSCav1_mut3 (opt1)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3492 - RNA, 1821 nt, synthetic construct
  misc_feature 1..1821: note = mRNA product Design a-1 comprising derived and/or modified sequence from HRSV(A2)__F-del_DSCav1_mut3 (opt2)
  source 1..1821: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3493 - RNA, 1821 nt, synthetic construct
  misc_feature 1..1821: note = mRNA product Design a-1 comprising derived and/or modified sequence from HRSV(A2)__F-del_DSCav1_mut3 (opt3)
  source 1..1821: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3494 - RNA, 1821 nt, synthetic construct
  misc_feature 1..1821: note = mRNA product Design a-1 comprising derived and/or modified sequence from HRSV(A2)__F-del_DSCav1_mut3 (opt4)
  source 1..1821: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3495 - RNA, 1821 nt, synthetic construct
  misc_feature 1..1821: note = mRNA product Design a-1 comprising derived and/or modified sequence from HRSV(A2)__F-del_DSCav1_mut3 (opt5)
  source 1..1821: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3496 - RNA, 1821 nt, synthetic construct
  misc_feature 1..1821: note = mRNA product Design a-1 comprising derived and/or modified sequence from HRSV(A2)__F-del_DSCav1_mut3 (opt6)
  source 1..1821: mol_type = other RNA
gggagagtcccgcagtcggcgtccagcggctctgcttgttcgtgtgtgtgtcgttgcaggccttattcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3497 - RNA, 1821 nt, synthetic construct
  misc_feature 1..1821: note = mRNA product Design a-1 comprising derived and/or modified sequence from HRSV(A2)__F-del_DSCav1_mut3 (opt11)
  source 1..1821: mol_type = other RNA
gggagagtcccgcagtcggcgtccagcggctctgcttgttcgtgtgtgtgtcgttgcaggccttattcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3498 - RNA, 1840 nt, synthetic construct
  misc_feature 1..1840: note = mRNA product Design a-2 comprising derived and/or modified sequence from HRSV(A2)__F-del_DSCav1_mut3 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3499 - RNA, 1840 nt, synthetic construct
  misc_feature 1..1840: note = mRNA product Design a-2 comprising derived and/or modified sequence from HRSV(A2)__F-del_DSCav1_mut3 (opt1)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3500 - RNA, 1840 nt, synthetic construct
  misc_feature 1..1840: note = mRNA product Design a-2 comprising derived and/or modified sequence from HRSV(A2)__F-del_DSCav1_mut3 (opt2)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3501 - RNA, 1840 nt, synthetic construct
  misc_feature 1..1840: note = mRNA product Design a-2 comprising derived and/or modified sequence from HRSV(A2)__F-del_DSCav1_mut3 (opt3)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3502 - RNA, 1840 nt, synthetic construct
  misc_feature 1..1840: note = mRNA product Design a-2 comprising derived and/or modified sequence from HRSV(A2)__F-del_DSCav1_mut3 (opt4)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3503 - RNA, 1840 nt, synthetic construct
  misc_feature 1..1840: note = mRNA product Design a-2 comprising derived and/or modified sequence from HRSV(A2)__F-del_DSCav1_mut3 (opt5)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3504 - RNA, 1840 nt, synthetic construct
  misc_feature 1..1840: note = mRNA product Design a-2 comprising derived and/or modified sequence from HRSV(A2)__F-del_DSCav1_mut3 (opt6)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3505 - RNA, 1840 nt, synthetic construct
  misc_feature 1..1840: note = mRNA product Design a-2 comprising derived and/or modified sequence from HRSV(A2)__F-del_DSCav1_mut3 (opt11)
  source 1..1840: mol_type = other RNA
gggagagtccgctcagccaggttgcagaagcggcttagcgtgtgtcctaatcttctctctgcgtgtaggtaggcctgtgccgcaaacaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3506 - RNA, 1918 nt, synthetic construct
  misc_feature 1..1918: note = mRNA product Design a-3 comprising derived and/or modified sequence from HRSV(A2)__F-del_DSCav1_mut3 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3507 - RNA, 1918 nt, synthetic construct
  misc_feature 1..1918: note = mRNA product Design a-3 comprising derived and/or modified sequence from HRSV(A2)__F-del_DSCav1_mut3 (opt1)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3508 - RNA, 1918 nt, synthetic construct
  misc_feature 1..1918: note = mRNA product Design a-3 comprising derived and/or modified sequence from HRSV(A2)__F-del_DSCav1_mut3 (opt2)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3509 - RNA, 1918 nt, synthetic construct
  misc_feature 1..1918: note = mRNA product Design a-3 comprising derived and/or modified sequence from HRSV(A2)__F-del_DSCav1_mut3 (opt3)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3510 - RNA, 1918 nt, synthetic construct
  misc_feature 1..1918: note = mRNA product Design a-3 comprising derived and/or modified sequence from HRSV(A2)__F-del_DSCav1_mut3 (opt4)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3511 - RNA, 1918 nt, synthetic construct
  misc_feature 1..1918: note = mRNA product Design a-3 comprising derived and/or modified sequence from HRSV(A2)__F-del_DSCav1_mut3 (opt5)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3512 - RNA, 1918 nt, synthetic construct
  misc_feature 1..1918: note = mRNA product Design a-3 comprising derived and/or modified sequence from HRSV(A2)__F-del_DSCav1_mut3 (opt6)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3513 - RNA, 1918 nt, synthetic construct
  misc_feature 1..1918: note = mRNA product Design a-3 comprising derived and/or modified sequence from HRSV(A2)__F-del_DSCav1_mut3 (opt11)
  source 1..1918: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3514 - RNA, 1867 nt, synthetic construct
  misc_feature 1..1867: note = mRNA product Design a-4 comprising derived and/or modified sequence from HRSV(A2)__F-del_DSCav1_mut3 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3515 - RNA, 1867 nt, synthetic construct
  misc_feature 1..1867: note = mRNA product Design a-4 comprising derived and/or modified sequence from HRSV(A2)__F-del_DSCav1_mut3 (opt1)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3516 - RNA, 1867 nt, synthetic construct
  misc_feature 1..1867: note = mRNA product Design a-4 comprising derived and/or modified sequence from HRSV(A2)__F-del_DSCav1_mut3 (opt2)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3517 - RNA, 1867 nt, synthetic construct
  misc_feature 1..1867: note = mRNA product Design a-4 comprising derived and/or modified sequence from HRSV(A2)__F-del_DSCav1_mut3 (opt3)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3518 - RNA, 1867 nt, synthetic construct
  misc_feature 1..1867: note = mRNA product Design a-4 comprising derived and/or modified sequence from HRSV(A2)__F-del_DSCav1_mut3 (opt4)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3519 - RNA, 1867 nt, synthetic construct
  misc_feature 1..1867: note = mRNA product Design a-4 comprising derived and/or modified sequence from HRSV(A2)__F-del_DSCav1_mut3 (opt5)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3520 - RNA, 1867 nt, synthetic construct
  misc_feature 1..1867: note = mRNA product Design a-4 comprising derived and/or modified sequence from HRSV(A2)__F-del_DSCav1_mut3 (opt6)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3521 - RNA, 1867 nt, synthetic construct
  misc_feature 1..1867: note = mRNA product Design a-4 comprising derived and/or modified sequence from HRSV(A2)__F-del_DSCav1_mut3 (opt11)
  source 1..1867: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3522 - RNA, 1813 nt, synthetic construct
  misc_feature 1..1813: note = mRNA product Design a-5 comprising derived and/or modified sequence from HRSV(A2)__F-del_DSCav1_mut3 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3523 - RNA, 1813 nt, synthetic construct
  misc_feature 1..1813: note = mRNA product Design a-5 comprising derived and/or modified sequence from HRSV(A2)__F-del_DSCav1_mut3 (opt1)
  source 1..1813: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3524 - RNA, 1813 nt, synthetic construct
  misc_feature 1..1813: note = mRNA product Design a-5 comprising derived and/or modified sequence from HRSV(A2)__F-del_DSCav1_mut3 (opt2)
  source 1..1813: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3525 - RNA, 1813 nt, synthetic construct
  misc_feature 1..1813: note = mRNA product Design a-5 comprising derived and/or modified sequence from HRSV(A2)__F-del_DSCav1_mut3 (opt3)
  source 1..1813: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3526 - RNA, 1813 nt, synthetic construct
  misc_feature 1..1813: note = mRNA product Design a-5 comprising derived and/or modified sequence from HRSV(A2)__F-del_DSCav1_mut3 (opt4)
  source 1..1813: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3527 - RNA, 1813 nt, synthetic construct
  misc_feature 1..1813: note = mRNA product Design a-5 comprising derived and/or modified sequence from HRSV(A2)__F-del_DSCav1_mut3 (opt5)
  source 1..1813: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3528 - RNA, 1813 nt, synthetic construct
  misc_feature 1..1813: note = mRNA product Design a-5 comprising derived and/or modified sequence from HRSV(A2)__F-del_DSCav1_mut3 (opt6)
  source 1..1813: mol_type = other RNA
gggagactttcccattctgtagcagaatttggtgttgcctgtggtcttggtcccgcggagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3529 - RNA, 1813 nt, synthetic construct
  misc_feature 1..1813: note = mRNA product Design a-5 comprising derived and/or modified sequence from HRSV(A2)__F-del_DSCav1_mut3 (opt11)
  source 1..1813: mol_type = other RNA
gggagactttcccattctgtagcagaatttggtgttgcctgtggtcttggtcccgcggagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3530 - RNA, 1994 nt, synthetic construct
  misc_feature 1..1994: note = mRNA product Design b-1 comprising derived and/or modified sequence from HRSV(A2)__F-del_DSCav1_mut3 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3531 - RNA, 1994 nt, synthetic construct
  misc_feature 1..1994: note = mRNA product Design b-1 comprising derived and/or modified sequence from HRSV(A2)__F-del_DSCav1_mut3 (opt1)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3532 - RNA, 1994 nt, synthetic construct
  misc_feature 1..1994: note = mRNA product Design b-1 comprising derived and/or modified sequence from HRSV(A2)__F-del_DSCav1_mut3 (opt2)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3533 - RNA, 1994 nt, synthetic construct
  misc_feature 1..1994: note = mRNA product Design b-1 comprising derived and/or modified sequence from HRSV(A2)__F-del_DSCav1_mut3 (opt3)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3534 - RNA, 1994 nt, synthetic construct
  misc_feature 1..1994: note = mRNA product Design b-1 comprising derived and/or modified sequence from HRSV(A2)__F-del_DSCav1_mut3 (opt4)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3535 - RNA, 1994 nt, synthetic construct
  misc_feature 1..1994: note = mRNA product Design b-1 comprising derived and/or modified sequence from HRSV(A2)__F-del_DSCav1_mut3 (opt5)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3536 - RNA, 1994 nt, synthetic construct
  misc_feature 1..1994: note = mRNA product Design b-1 comprising derived and/or modified sequence from HRSV(A2)__F-del_DSCav1_mut3 (opt6)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3537 - RNA, 1994 nt, synthetic construct
  misc_feature 1..1994: note = mRNA product Design b-1 comprising derived and/or modified sequence from HRSV(A2)__F-del_DSCav1_mut3 (opt11)
  source 1..1994: mol_type = other RNA
gggagacggagacggcctgcaggacctgctctctcagccctcagccgaggcctacgccgagccgagtgcgcagccgacgaccgggaggagccgcagccttcaactctgaggtactgtgatccgcgctgcccgccgggccgccccagtccgctgctgcggcacctccttccctcgcgccctcttcgctcgccagcgccttccctgtgagcctgcgtcaccgcggccgccaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3538 - RNA, 1814 nt, synthetic construct
  misc_feature 1..1814: note = mRNA product Design b-2 comprising derived and/or modified sequence from HRSV(A2)__F-del_DSCav1_mut3 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3539 - RNA, 1814 nt, synthetic construct
  misc_feature 1..1814: note = mRNA product Design b-2 comprising derived and/or modified sequence from HRSV(A2)__F-del_DSCav1_mut3 (opt1)
  source 1..1814: mol_type = other RNA
gggagagcctctgctggagtccggggagtggcgttggctgctagagcgaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3540 - RNA, 1814 nt, synthetic construct
  misc_feature 1..1814: note = mRNA product Design b-2 comprising derived and/or modified sequence from HRSV(A2)__F-del_DSCav1_mut3 (opt2)
  source 1..1814: mol_type = other RNA
gggagagcctctgctggagtccggggagtggcgttggctgctagagcgaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3541 - RNA, 1814 nt, synthetic construct
  misc_feature 1..1814: note = mRNA product Design b-2 comprising derived and/or modified sequence from HRSV(A2)__F-del_DSCav1_mut3 (opt3)
  source 1..1814: mol_type = other RNA
gggagagcctctgctggagtccggggagtggcgttggctgctagagcgaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3542 - RNA, 1814 nt, synthetic construct
  misc_feature 1..1814: note = mRNA product Design b-2 comprising derived and/or modified sequence from HRSV(A2)__F-del_DSCav1_mut3 (opt4)
  source 1..1814: mol_type = other RNA
gggagagcctctgctggagtccggggagtggcgttggctgctagagcgaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3543 - RNA, 1814 nt, synthetic construct
  misc_feature 1..1814: note = mRNA product Design b-2 comprising derived and/or modified sequence from HRSV(A2)__F-del_DSCav1_mut3 (opt5)
  source 1..1814: mol_type = other RNA
gggagagcctctgctggagtccggggagtggcgttggctgctagagcgaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3544 - RNA, 1814 nt, synthetic construct
  misc_feature 1..1814: note = mRNA product Design b-2 comprising derived and/or modified sequence from HRSV(A2)__F-del_DSCav1_mut3 (opt6)
  source 1..1814: mol_type = other RNA
gggagagcctctgctggagtccggggagtggcgttggctgctagagcgaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3545 - RNA, 1814 nt, synthetic construct
  misc_feature 1..1814: note = mRNA product Design b-2 comprising derived and/or modified sequence from HRSV(A2)__F-del_DSCav1_mut3 (opt11)
  source 1..1814: mol_type = other RNA
gggagagcctctgctggagtccggggagtggcgttggctgctagagcgaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3546 - RNA, 1834 nt, synthetic construct
  misc_feature 1..1834: note = mRNA product Design b-3 comprising derived and/or modified sequence from HRSV(A2)__F-del_DSCav1_mut3 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3547 - RNA, 1834 nt, synthetic construct
  misc_feature 1..1834: note = mRNA product Design b-3 comprising derived and/or modified sequence from HRSV(A2)__F-del_DSCav1_mut3 (opt1)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3548 - RNA, 1834 nt, synthetic construct
  misc_feature 1..1834: note = mRNA product Design b-3 comprising derived and/or modified sequence from HRSV(A2)__F-del_DSCav1_mut3 (opt2)
  source 1..1834: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3549 - RNA, 1834 nt, synthetic construct
  misc_feature 1..1834: note = mRNA product Design b-3 comprising derived and/or modified sequence from HRSV(A2)__F-del_DSCav1_mut3 (opt3)
  source 1..1834: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3550 - RNA, 1834 nt, synthetic construct
  misc_feature 1..1834: note = mRNA product Design b-3 comprising derived and/or modified sequence from HRSV(A2)__F-del_DSCav1_mut3 (opt4)
  source 1..1834: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3551 - RNA, 1834 nt, synthetic construct
  misc_feature 1..1834: note = mRNA product Design b-3 comprising derived and/or modified sequence from HRSV(A2)__F-del_DSCav1_mut3 (opt5)
  source 1..1834: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3552 - RNA, 1834 nt, synthetic construct
  misc_feature 1..1834: note = mRNA product Design b-3 comprising derived and/or modified sequence from HRSV(A2)__F-del_DSCav1_mut3 (opt6)
  source 1..1834: mol_type = other RNA
gggagagtcccgcagtcggcgtccagcggctctgcttgttcgtgtgtgtgtcgttgcaggccttattcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3553 - RNA, 1834 nt, synthetic construct
  misc_feature 1..1834: note = mRNA product Design b-3 comprising derived and/or modified sequence from HRSV(A2)__F-del_DSCav1_mut3 (opt11)
  source 1..1834: mol_type = other RNA
gggagagtcccgcagtcggcgtccagcggctctgcttgttcgtgtgtgtgtcgttgcaggccttattcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3554 - RNA, 1885 nt, synthetic construct
  misc_feature 1..1885: note = mRNA product Design b-4 comprising derived and/or modified sequence from HRSV(A2)__F-del_DSCav1_mut3 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3555 - RNA, 1885 nt, synthetic construct
  misc_feature 1..1885: note = mRNA product Design b-4 comprising derived and/or modified sequence from HRSV(A2)__F-del_DSCav1_mut3 (opt1)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3556 - RNA, 1885 nt, synthetic construct
  misc_feature 1..1885: note = mRNA product Design b-4 comprising derived and/or modified sequence from HRSV(A2)__F-del_DSCav1_mut3 (opt2)
  source 1..1885: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3557 - RNA, 1885 nt, synthetic construct
  misc_feature 1..1885: note = mRNA product Design b-4 comprising derived and/or modified sequence from HRSV(A2)__F-del_DSCav1_mut3 (opt3)
  source 1..1885: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3558 - RNA, 1885 nt, synthetic construct
  misc_feature 1..1885: note = mRNA product Design b-4 comprising derived and/or modified sequence from HRSV(A2)__F-del_DSCav1_mut3 (opt4)
  source 1..1885: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3559 - RNA, 1885 nt, synthetic construct
  misc_feature 1..1885: note = mRNA product Design b-4 comprising derived and/or modified sequence from HRSV(A2)__F-del_DSCav1_mut3 (opt5)
  source 1..1885: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3560 - RNA, 1885 nt, synthetic construct
  misc_feature 1..1885: note = mRNA product Design b-4 comprising derived and/or modified sequence from HRSV(A2)__F-del_DSCav1_mut3 (opt6)
  source 1..1885: mol_type = other RNA
gggagagtcccgcagtcggcgtccagcggctctgcttgttcgtgtgtgtgtcgttgcaggccttattcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3561 - RNA, 1885 nt, synthetic construct
  misc_feature 1..1885: note = mRNA product Design b-4 comprising derived and/or modified sequence from HRSV(A2)__F-del_DSCav1_mut3 (opt11)
  source 1..1885: mol_type = other RNA
gggagagtcccgcagtcggcgtccagcggctctgcttgttcgtgtgtgtgtcgttgcaggccttattcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3562 - RNA, 1947 nt, synthetic construct
  misc_feature 1..1947: note = mRNA product Design b-5 comprising derived and/or modified sequence from HRSV(A2)__F-del_DSCav1_mut3 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3563 - RNA, 1947 nt, synthetic construct
  misc_feature 1..1947: note = mRNA product Design b-5 comprising derived and/or modified sequence from HRSV(A2)__F-del_DSCav1_mut3 (opt1)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3564 - RNA, 1947 nt, synthetic construct
  misc_feature 1..1947: note = mRNA product Design b-5 comprising derived and/or modified sequence from HRSV(A2)__F-del_DSCav1_mut3 (opt2)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3565 - RNA, 1947 nt, synthetic construct
  misc_feature 1..1947: note = mRNA product Design b-5 comprising derived and/or modified sequence from HRSV(A2)__F-del_DSCav1_mut3 (opt3)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3566 - RNA, 1947 nt, synthetic construct
  misc_feature 1..1947: note = mRNA product Design b-5 comprising derived and/or modified sequence from HRSV(A2)__F-del_DSCav1_mut3 (opt4)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3567 - RNA, 1947 nt, synthetic construct
  misc_feature 1..1947: note = mRNA product Design b-5 comprising derived and/or modified sequence from HRSV(A2)__F-del_DSCav1_mut3 (opt5)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3568 - RNA, 1947 nt, synthetic construct
  misc_feature 1..1947: note = mRNA product Design b-5 comprising derived and/or modified sequence from HRSV(A2)__F-del_DSCav1_mut3 (opt6)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3569 - RNA, 1947 nt, synthetic construct
  misc_feature 1..1947: note = mRNA product Design b-5 comprising derived and/or modified sequence from HRSV(A2)__F-del_DSCav1_mut3 (opt11)
  source 1..1947: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3570 - RNA, 1853 nt, synthetic construct
  misc_feature 1..1853: note = mRNA product Design c-1 comprising derived and/or modified sequence from HRSV(A2)__F-del_DSCav1_mut3 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3571 - RNA, 1853 nt, synthetic construct
  misc_feature 1..1853: note = mRNA product Design c-1 comprising derived and/or modified sequence from HRSV(A2)__F-del_DSCav1_mut3 (opt1)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3572 - RNA, 1853 nt, synthetic construct
  misc_feature 1..1853: note = mRNA product Design c-1 comprising derived and/or modified sequence from HRSV(A2)__F-del_DSCav1_mut3 (opt2)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3573 - RNA, 1853 nt, synthetic construct
  misc_feature 1..1853: note = mRNA product Design c-1 comprising derived and/or modified sequence from HRSV(A2)__F-del_DSCav1_mut3 (opt3)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3574 - RNA, 1853 nt, synthetic construct
  misc_feature 1..1853: note = mRNA product Design c-1 comprising derived and/or modified sequence from HRSV(A2)__F-del_DSCav1_mut3 (opt4)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3575 - RNA, 1853 nt, synthetic construct
  misc_feature 1..1853: note = mRNA product Design c-1 comprising derived and/or modified sequence from HRSV(A2)__F-del_DSCav1_mut3 (opt5)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3576 - RNA, 1853 nt, synthetic construct
  misc_feature 1..1853: note = mRNA product Design c-1 comprising derived and/or modified sequence from HRSV(A2)__F-del_DSCav1_mut3 (opt6)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3577 - RNA, 1853 nt, synthetic construct
  misc_feature 1..1853: note = mRNA product Design c-1 comprising derived and/or modified sequence from HRSV(A2)__F-del_DSCav1_mut3 (opt11)
  source 1..1853: mol_type = other RNA
gggagagtccgctcagccaggttgcagaagcggcttagcgtgtgtcctaatcttctctctgcgtgtaggtaggcctgtgccgcaaacaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3578 - RNA, 1943 nt, synthetic construct
  misc_feature 1..1943: note = mRNA product Design c-2 comprising derived and/or modified sequence from HRSV(A2)__F-del_DSCav1_mut3 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3579 - RNA, 1943 nt, synthetic construct
  misc_feature 1..1943: note = mRNA product Design c-2 comprising derived and/or modified sequence from HRSV(A2)__F-del_DSCav1_mut3 (opt1)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3580 - RNA, 1943 nt, synthetic construct
  misc_feature 1..1943: note = mRNA product Design c-2 comprising derived and/or modified sequence from HRSV(A2)__F-del_DSCav1_mut3 (opt2)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3581 - RNA, 1943 nt, synthetic construct
  misc_feature 1..1943: note = mRNA product Design c-2 comprising derived and/or modified sequence from HRSV(A2)__F-del_DSCav1_mut3 (opt3)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3582 - RNA, 1943 nt, synthetic construct
  misc_feature 1..1943: note = mRNA product Design c-2 comprising derived and/or modified sequence from HRSV(A2)__F-del_DSCav1_mut3 (opt4)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3583 - RNA, 1943 nt, synthetic construct
  misc_feature 1..1943: note = mRNA product Design c-2 comprising derived and/or modified sequence from HRSV(A2)__F-del_DSCav1_mut3 (opt5)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3584 - RNA, 1943 nt, synthetic construct
  misc_feature 1..1943: note = mRNA product Design c-2 comprising derived and/or modified sequence from HRSV(A2)__F-del_DSCav1_mut3 (opt6)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3585 - RNA, 1943 nt, synthetic construct
  misc_feature 1..1943: note = mRNA product Design c-2 comprising derived and/or modified sequence from HRSV(A2)__F-del_DSCav1_mut3 (opt11)
  source 1..1943: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3586 - RNA, 1920 nt, synthetic construct
  misc_feature 1..1920: note = mRNA product Design c-3 comprising derived and/or modified sequence from HRSV(A2)__F-del_DSCav1_mut3 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3587 - RNA, 1920 nt, synthetic construct
  misc_feature 1..1920: note = mRNA product Design c-3 comprising derived and/or modified sequence from HRSV(A2)__F-del_DSCav1_mut3 (opt1)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3588 - RNA, 1920 nt, synthetic construct
  misc_feature 1..1920: note = mRNA product Design c-3 comprising derived and/or modified sequence from HRSV(A2)__F-del_DSCav1_mut3 (opt2)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3589 - RNA, 1920 nt, synthetic construct
  misc_feature 1..1920: note = mRNA product Design c-3 comprising derived and/or modified sequence from HRSV(A2)__F-del_DSCav1_mut3 (opt3)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3590 - RNA, 1920 nt, synthetic construct
  misc_feature 1..1920: note = mRNA product Design c-3 comprising derived and/or modified sequence from HRSV(A2)__F-del_DSCav1_mut3 (opt4)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3591 - RNA, 1920 nt, synthetic construct
  misc_feature 1..1920: note = mRNA product Design c-3 comprising derived and/or modified sequence from HRSV(A2)__F-del_DSCav1_mut3 (opt5)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3592 - RNA, 1920 nt, synthetic construct
  misc_feature 1..1920: note = mRNA product Design c-3 comprising derived and/or modified sequence from HRSV(A2)__F-del_DSCav1_mut3 (opt6)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3593 - RNA, 1920 nt, synthetic construct
  misc_feature 1..1920: note = mRNA product Design c-3 comprising derived and/or modified sequence from HRSV(A2)__F-del_DSCav1_mut3 (opt11)
  source 1..1920: mol_type = other RNA
gggagagtccgctcagccaggttgcagaagcggcttagcgtgtgtcctaatcttctctctgcgtgtaggtaggcctgtgccgcaaacaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3594 - RNA, 1916 nt, synthetic construct
  misc_feature 1..1916: note = mRNA product Design c-4 comprising derived and/or modified sequence from HRSV(A2)__F-del_DSCav1_mut3 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3595 - RNA, 1916 nt, synthetic construct
  misc_feature 1..1916: note = mRNA product Design c-4 comprising derived and/or modified sequence from HRSV(A2)__F-del_DSCav1_mut3 (opt1)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3596 - RNA, 1916 nt, synthetic construct
  misc_feature 1..1916: note = mRNA product Design c-4 comprising derived and/or modified sequence from HRSV(A2)__F-del_DSCav1_mut3 (opt2)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3597 - RNA, 1916 nt, synthetic construct
  misc_feature 1..1916: note = mRNA product Design c-4 comprising derived and/or modified sequence from HRSV(A2)__F-del_DSCav1_mut3 (opt3)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3598 - RNA, 1916 nt, synthetic construct
  misc_feature 1..1916: note = mRNA product Design c-4 comprising derived and/or modified sequence from HRSV(A2)__F-del_DSCav1_mut3 (opt4)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3599 - RNA, 1916 nt, synthetic construct
  misc_feature 1..1916: note = mRNA product Design c-4 comprising derived and/or modified sequence from HRSV(A2)__F-del_DSCav1_mut3 (opt5)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3600 - RNA, 1916 nt, synthetic construct
  misc_feature 1..1916: note = mRNA product Design c-4 comprising derived and/or modified sequence from HRSV(A2)__F-del_DSCav1_mut3 (opt6)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3601 - RNA, 1916 nt, synthetic construct
  misc_feature 1..1916: note = mRNA product Design c-4 comprising derived and/or modified sequence from HRSV(A2)__F-del_DSCav1_mut3 (opt11)
  source 1..1916: mol_type = other RNA
gggagagtccgctcagccaggttgcagaagcggcttagcgtgtgtcctaatcttctctctgcgtgtaggtaggcctgtgccgcaaacaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3602 - RNA, 1834 nt, synthetic construct
  misc_feature 1..1834: note = mRNA product Design c-5 comprising derived and/or modified sequence from HRSV(A2)__F-del_DSCav1_mut3 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3603 - RNA, 1834 nt, synthetic construct
  misc_feature 1..1834: note = mRNA product Design c-5 comprising derived and/or modified sequence from HRSV(A2)__F-del_DSCav1_mut3 (opt1)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3604 - RNA, 1834 nt, synthetic construct
  misc_feature 1..1834: note = mRNA product Design c-5 comprising derived and/or modified sequence from HRSV(A2)__F-del_DSCav1_mut3 (opt2)
  source 1..1834: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3605 - RNA, 1834 nt, synthetic construct
  misc_feature 1..1834: note = mRNA product Design c-5 comprising derived and/or modified sequence from HRSV(A2)__F-del_DSCav1_mut3 (opt3)
  source 1..1834: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3606 - RNA, 1834 nt, synthetic construct
  misc_feature 1..1834: note = mRNA product Design c-5 comprising derived and/or modified sequence from HRSV(A2)__F-del_DSCav1_mut3 (opt4)
  source 1..1834: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3607 - RNA, 1834 nt, synthetic construct
  misc_feature 1..1834: note = mRNA product Design c-5 comprising derived and/or modified sequence from HRSV(A2)__F-del_DSCav1_mut3 (opt5)
  source 1..1834: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3608 - RNA, 1834 nt, synthetic construct
  misc_feature 1..1834: note = mRNA product Design c-5 comprising derived and/or modified sequence from HRSV(A2)__F-del_DSCav1_mut3 (opt6)
  source 1..1834: mol_type = other RNA
gggagagcggctcggccattttgtcccagtcagtccggaggctgcggctgcagaagtaccgcctgcggagtaactgcaaagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3609 - RNA, 1834 nt, synthetic construct
  misc_feature 1..1834: note = mRNA product Design c-5 comprising derived and/or modified sequence from HRSV(A2)__F-del_DSCav1_mut3 (opt11)
  source 1..1834: mol_type = other RNA
gggagagcggctcggccattttgtcccagtcagtccggaggctgcggctgcagaagtaccgcctgcggagtaactgcaaagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3610 - RNA, 1843 nt, synthetic construct
  misc_feature 1..1843: note = mRNA product Design d-1 comprising derived and/or modified sequence from HRSV(A2)__F-del_DSCav1_mut3 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3611 - RNA, 1843 nt, synthetic construct
  misc_feature 1..1843: note = mRNA product Design d-1 comprising derived and/or modified sequence from HRSV(A2)__F-del_DSCav1_mut3 (opt1)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3612 - RNA, 1843 nt, synthetic construct
  misc_feature 1..1843: note = mRNA product Design d-1 comprising derived and/or modified sequence from HRSV(A2)__F-del_DSCav1_mut3 (opt2)
  source 1..1843: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3613 - RNA, 1843 nt, synthetic construct
  misc_feature 1..1843: note = mRNA product Design d-1 comprising derived and/or modified sequence from HRSV(A2)__F-del_DSCav1_mut3 (opt3)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3614 - RNA, 1843 nt, synthetic construct
  misc_feature 1..1843: note = mRNA product Design d-1 comprising derived and/or modified sequence from HRSV(A2)__F-del_DSCav1_mut3 (opt4)
  source 1..1843: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3615 - RNA, 1843 nt, synthetic construct
  misc_feature 1..1843: note = mRNA product Design d-1 comprising derived and/or modified sequence from HRSV(A2)__F-del_DSCav1_mut3 (opt5)
  source 1..1843: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3616 - RNA, 1843 nt, synthetic construct
  misc_feature 1..1843: note = mRNA product Design d-1 comprising derived and/or modified sequence from HRSV(A2)__F-del_DSCav1_mut3 (opt6)
  source 1..1843: mol_type = other RNA
gggagacccgtgacccggaagttgtacggctacgcgactttccctcccacaaaccctcgcgcccttcctttcctacttgggcccggcagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3617 - RNA, 1843 nt, synthetic construct
  misc_feature 1..1843: note = mRNA product Design d-1 comprising derived and/or modified sequence from HRSV(A2)__F-del_DSCav1_mut3 (opt11)
  source 1..1843: mol_type = other RNA
gggagacccgtgacccggaagttgtacggctacgcgactttccctcccacaaaccctcgcgcccttcctttcctacttgggcccggcagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3618 - RNA, 1898 nt, synthetic construct
  misc_feature 1..1898: note = mRNA product Design d-2 comprising derived and/or modified sequence from HRSV(A2)__F-del_DSCav1_mut3 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3619 - RNA, 1898 nt, synthetic construct
  misc_feature 1..1898: note = mRNA product Design d-2 comprising derived and/or modified sequence from HRSV(A2)__F-del_DSCav1_mut3 (opt1)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3620 - RNA, 1898 nt, synthetic construct
  misc_feature 1..1898: note = mRNA product Design d-2 comprising derived and/or modified sequence from HRSV(A2)__F-del_DSCav1_mut3 (opt2)
  source 1..1898: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3621 - RNA, 1898 nt, synthetic construct
  misc_feature 1..1898: note = mRNA product Design d-2 comprising derived and/or modified sequence from HRSV(A2)__F-del_DSCav1_mut3 (opt3)
  source 1..1898: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3622 - RNA, 1898 nt, synthetic construct
  misc_feature 1..1898: note = mRNA product Design d-2 comprising derived and/or modified sequence from HRSV(A2)__F-del_DSCav1_mut3 (opt4)
  source 1..1898: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3623 - RNA, 1898 nt, synthetic construct
  misc_feature 1..1898: note = mRNA product Design d-2 comprising derived and/or modified sequence from HRSV(A2)__F-del_DSCav1_mut3 (opt5)
  source 1..1898: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3624 - RNA, 1898 nt, synthetic construct
  misc_feature 1..1898: note = mRNA product Design d-2 comprising derived and/or modified sequence from HRSV(A2)__F-del_DSCav1_mut3 (opt6)
  source 1..1898: mol_type = other RNA
gggagagcggctcggccattttgtcccagtcagtccggaggctgcggctgcagaagtaccgcctgcggagtaactgcaaagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3625 - RNA, 1898 nt, synthetic construct
  misc_feature 1..1898: note = mRNA product Design d-2 comprising derived and/or modified sequence from HRSV(A2)__F-del_DSCav1_mut3 (opt11)
  source 1..1898: mol_type = other RNA
gggagagcggctcggccattttgtcccagtcagtccggaggctgcggctgcagaagtaccgcctgcggagtaactgcaaagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3626 - RNA, 2214 nt, synthetic construct
  misc_feature 1..2214: note = mRNA product Design d-3 comprising derived and/or modified sequence from HRSV(A2)__F-del_DSCav1_mut3 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3627 - RNA, 2214 nt, synthetic construct
  misc_feature 1..2214: note = mRNA product Design d-3 comprising derived and/or modified sequence from HRSV(A2)__F-del_DSCav1_mut3 (opt1)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3628 - RNA, 2214 nt, synthetic construct
  misc_feature 1..2214: note = mRNA product Design d-3 comprising derived and/or modified sequence from HRSV(A2)__F-del_DSCav1_mut3 (opt2)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3629 - RNA, 2214 nt, synthetic construct
  misc_feature 1..2214: note = mRNA product Design d-3 comprising derived and/or modified sequence from HRSV(A2)__F-del_DSCav1_mut3 (opt3)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3630 - RNA, 2214 nt, synthetic construct
  misc_feature 1..2214: note = mRNA product Design d-3 comprising derived and/or modified sequence from HRSV(A2)__F-del_DSCav1_mut3 (opt4)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3631 - RNA, 2214 nt, synthetic construct
  misc_feature 1..2214: note = mRNA product Design d-3 comprising derived and/or modified sequence from HRSV(A2)__F-del_DSCav1_mut3 (opt5)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3632 - RNA, 2214 nt, synthetic construct
  misc_feature 1..2214: note = mRNA product Design d-3 comprising derived and/or modified sequence from HRSV(A2)__F-del_DSCav1_mut3 (opt6)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3633 - RNA, 2214 nt, synthetic construct
  misc_feature 1..2214: note = mRNA product Design d-3 comprising derived and/or modified sequence from HRSV(A2)__F-del_DSCav1_mut3 (opt11)
  source 1..2214: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3634 - RNA, 1897 nt, synthetic construct
  misc_feature 1..1897: note = mRNA product Design d-4 comprising derived and/or modified sequence from HRSV(A2)__F-del_DSCav1_mut3 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3635 - RNA, 1897 nt, synthetic construct
  misc_feature 1..1897: note = mRNA product Design d-4 comprising derived and/or modified sequence from HRSV(A2)__F-del_DSCav1_mut3 (opt1)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3636 - RNA, 1897 nt, synthetic construct
  misc_feature 1..1897: note = mRNA product Design d-4 comprising derived and/or modified sequence from HRSV(A2)__F-del_DSCav1_mut3 (opt2)
  source 1..1897: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3637 - RNA, 1897 nt, synthetic construct
  misc_feature 1..1897: note = mRNA product Design d-4 comprising derived and/or modified sequence from HRSV(A2)__F-del_DSCav1_mut3 (opt3)
  source 1..1897: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3638 - RNA, 1897 nt, synthetic construct
  misc_feature 1..1897: note = mRNA product Design d-4 comprising derived and/or modified sequence from HRSV(A2)__F-del_DSCav1_mut3 (opt4)
  source 1..1897: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3639 - RNA, 1897 nt, synthetic construct
  misc_feature 1..1897: note = mRNA product Design d-4 comprising derived and/or modified sequence from HRSV(A2)__F-del_DSCav1_mut3 (opt5)
  source 1..1897: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3640 - RNA, 1897 nt, synthetic construct
  misc_feature 1..1897: note = mRNA product Design d-4 comprising derived and/or modified sequence from HRSV(A2)__F-del_DSCav1_mut3 (opt6)
  source 1..1897: mol_type = other RNA
gggagagtcccgcagtcggcgtccagcggctctgcttgttcgtgtgtgtgtcgttgcaggccttattcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3641 - RNA, 1897 nt, synthetic construct
  misc_feature 1..1897: note = mRNA product Design d-4 comprising derived and/or modified sequence from HRSV(A2)__F-del_DSCav1_mut3 (opt11)
  source 1..1897: mol_type = other RNA
gggagagtcccgcagtcggcgtccagcggctctgcttgttcgtgtgtgtgtcgttgcaggccttattcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3642 - RNA, 1994 nt, synthetic construct
  misc_feature 1..1994: note = mRNA product Design d-5 comprising derived and/or modified sequence from HRSV(A2)__F-del_DSCav1_mut3 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3643 - RNA, 1994 nt, synthetic construct
  misc_feature 1..1994: note = mRNA product Design d-5 comprising derived and/or modified sequence from HRSV(A2)__F-del_DSCav1_mut3 (opt1)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3644 - RNA, 1994 nt, synthetic construct
  misc_feature 1..1994: note = mRNA product Design d-5 comprising derived and/or modified sequence from HRSV(A2)__F-del_DSCav1_mut3 (opt2)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3645 - RNA, 1994 nt, synthetic construct
  misc_feature 1..1994: note = mRNA product Design d-5 comprising derived and/or modified sequence from HRSV(A2)__F-del_DSCav1_mut3 (opt3)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3646 - RNA, 1994 nt, synthetic construct
  misc_feature 1..1994: note = mRNA product Design d-5 comprising derived and/or modified sequence from HRSV(A2)__F-del_DSCav1_mut3 (opt4)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3647 - RNA, 1994 nt, synthetic construct
  misc_feature 1..1994: note = mRNA product Design d-5 comprising derived and/or modified sequence from HRSV(A2)__F-del_DSCav1_mut3 (opt5)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3648 - RNA, 1994 nt, synthetic construct
  misc_feature 1..1994: note = mRNA product Design d-5 comprising derived and/or modified sequence from HRSV(A2)__F-del_DSCav1_mut3 (opt6)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3649 - RNA, 1994 nt, synthetic construct
  misc_feature 1..1994: note = mRNA product Design d-5 comprising derived and/or modified sequence from HRSV(A2)__F-del_DSCav1_mut3 (opt11)
  source 1..1994: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3650 - RNA, 1874 nt, synthetic construct
  misc_feature 1..1874: note = mRNA product Design e-1 comprising derived and/or modified sequence from HRSV(A2)__F-del_DSCav1_mut3 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3651 - RNA, 1874 nt, synthetic construct
  misc_feature 1..1874: note = mRNA product Design e-1 comprising derived and/or modified sequence from HRSV(A2)__F-del_DSCav1_mut3 (opt1)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3652 - RNA, 1874 nt, synthetic construct
  misc_feature 1..1874: note = mRNA product Design e-1 comprising derived and/or modified sequence from HRSV(A2)__F-del_DSCav1_mut3 (opt2)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3653 - RNA, 1874 nt, synthetic construct
  misc_feature 1..1874: note = mRNA product Design e-1 comprising derived and/or modified sequence from HRSV(A2)__F-del_DSCav1_mut3 (opt3)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3654 - RNA, 1874 nt, synthetic construct
  misc_feature 1..1874: note = mRNA product Design e-1 comprising derived and/or modified sequence from HRSV(A2)__F-del_DSCav1_mut3 (opt4)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3655 - RNA, 1874 nt, synthetic construct
  misc_feature 1..1874: note = mRNA product Design e-1 comprising derived and/or modified sequence from HRSV(A2)__F-del_DSCav1_mut3 (opt5)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3656 - RNA, 1874 nt, synthetic construct
  misc_feature 1..1874: note = mRNA product Design e-1 comprising derived and/or modified sequence from HRSV(A2)__F-del_DSCav1_mut3 (opt6)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3657 - RNA, 1874 nt, synthetic construct
  misc_feature 1..1874: note = mRNA product Design e-1 comprising derived and/or modified sequence from HRSV(A2)__F-del_DSCav1_mut3 (opt11)
  source 1..1874: mol_type = other RNA
gggagaatataagcgttggcggagcgtcggttgtagcactctgcgcgcccgctcttctgctgctgtttgtctacttcctcctgcttccccgccgccgccgccgccatcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3658 - RNA, 1856 nt, synthetic construct
  misc_feature 1..1856: note = mRNA product Design e-2 comprising derived and/or modified sequence from HRSV(A2)__F-del_DSCav1_mut3 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3659 - RNA, 1856 nt, synthetic construct
  misc_feature 1..1856: note = mRNA product Design e-2 comprising derived and/or modified sequence from HRSV(A2)__F-del_DSCav1_mut3 (opt1)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3660 - RNA, 1856 nt, synthetic construct
  misc_feature 1..1856: note = mRNA product Design e-2 comprising derived and/or modified sequence from HRSV(A2)__F-del_DSCav1_mut3 (opt2)
  source 1..1856: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3661 - RNA, 1856 nt, synthetic construct
  misc_feature 1..1856: note = mRNA product Design e-2 comprising derived and/or modified sequence from HRSV(A2)__F-del_DSCav1_mut3 (opt3)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3662 - RNA, 1856 nt, synthetic construct
  misc_feature 1..1856: note = mRNA product Design e-2 comprising derived and/or modified sequence from HRSV(A2)__F-del_DSCav1_mut3 (opt4)
  source 1..1856: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3663 - RNA, 1856 nt, synthetic construct
  misc_feature 1..1856: note = mRNA product Design e-2 comprising derived and/or modified sequence from HRSV(A2)__F-del_DSCav1_mut3 (opt5)
  source 1..1856: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3664 - RNA, 1856 nt, synthetic construct
  misc_feature 1..1856: note = mRNA product Design e-2 comprising derived and/or modified sequence from HRSV(A2)__F-del_DSCav1_mut3 (opt6)
  source 1..1856: mol_type = other RNA
gggagacccgtgacccggaagttgtacggctacgcgactttccctcccacaaaccctcgcgcccttcctttcctacttgggcccggcagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3665 - RNA, 1856 nt, synthetic construct
  misc_feature 1..1856: note = mRNA product Design e-2 comprising derived and/or modified sequence from HRSV(A2)__F-del_DSCav1_mut3 (opt11)
  source 1..1856: mol_type = other RNA
gggagacccgtgacccggaagttgtacggctacgcgactttccctcccacaaaccctcgcgcccttcctttcctacttgggcccggcagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3666 - RNA, 1826 nt, synthetic construct
  misc_feature 1..1826: note = mRNA product Design e-3 comprising derived and/or modified sequence from HRSV(A2)__F-del_DSCav1_mut3 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3667 - RNA, 1826 nt, synthetic construct
  misc_feature 1..1826: note = mRNA product Design e-3 comprising derived and/or modified sequence from HRSV(A2)__F-del_DSCav1_mut3 (opt1)
  source 1..1826: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3668 - RNA, 1826 nt, synthetic construct
  misc_feature 1..1826: note = mRNA product Design e-3 comprising derived and/or modified sequence from HRSV(A2)__F-del_DSCav1_mut3 (opt2)
  source 1..1826: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3669 - RNA, 1826 nt, synthetic construct
  misc_feature 1..1826: note = mRNA product Design e-3 comprising derived and/or modified sequence from HRSV(A2)__F-del_DSCav1_mut3 (opt3)
  source 1..1826: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3670 - RNA, 1826 nt, synthetic construct
  misc_feature 1..1826: note = mRNA product Design e-3 comprising derived and/or modified sequence from HRSV(A2)__F-del_DSCav1_mut3 (opt4)
  source 1..1826: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3671 - RNA, 1826 nt, synthetic construct
  misc_feature 1..1826: note = mRNA product Design e-3 comprising derived and/or modified sequence from HRSV(A2)__F-del_DSCav1_mut3 (opt5)
  source 1..1826: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3672 - RNA, 1826 nt, synthetic construct
  misc_feature 1..1826: note = mRNA product Design e-3 comprising derived and/or modified sequence from HRSV(A2)__F-del_DSCav1_mut3 (opt6)
  source 1..1826: mol_type = other RNA
gggagactttcccattctgtagcagaatttggtgttgcctgtggtcttggtcccgcggagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3673 - RNA, 1826 nt, synthetic construct
  misc_feature 1..1826: note = mRNA product Design e-3 comprising derived and/or modified sequence from HRSV(A2)__F-del_DSCav1_mut3 (opt11)
  source 1..1826: mol_type = other RNA
gggagactttcccattctgtagcagaatttggtgttgcctgtggtcttggtcccgcggagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3674 - RNA, 1880 nt, synthetic construct
  misc_feature 1..1880: note = mRNA product Design e-4 comprising derived and/or modified sequence from HRSV(A2)__F-del_DSCav1_mut3 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3675 - RNA, 1880 nt, synthetic construct
  misc_feature 1..1880: note = mRNA product Design e-4 comprising derived and/or modified sequence from HRSV(A2)__F-del_DSCav1_mut3 (opt1)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3676 - RNA, 1880 nt, synthetic construct
  misc_feature 1..1880: note = mRNA product Design e-4 comprising derived and/or modified sequence from HRSV(A2)__F-del_DSCav1_mut3 (opt2)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3677 - RNA, 1880 nt, synthetic construct
  misc_feature 1..1880: note = mRNA product Design e-4 comprising derived and/or modified sequence from HRSV(A2)__F-del_DSCav1_mut3 (opt3)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3678 - RNA, 1880 nt, synthetic construct
  misc_feature 1..1880: note = mRNA product Design e-4 comprising derived and/or modified sequence from HRSV(A2)__F-del_DSCav1_mut3 (opt4)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3679 - RNA, 1880 nt, synthetic construct
  misc_feature 1..1880: note = mRNA product Design e-4 comprising derived and/or modified sequence from HRSV(A2)__F-del_DSCav1_mut3 (opt5)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3680 - RNA, 1880 nt, synthetic construct
  misc_feature 1..1880: note = mRNA product Design e-4 comprising derived and/or modified sequence from HRSV(A2)__F-del_DSCav1_mut3 (opt6)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3681 - RNA, 1880 nt, synthetic construct
  misc_feature 1..1880: note = mRNA product Design e-4 comprising derived and/or modified sequence from HRSV(A2)__F-del_DSCav1_mut3 (opt11)
  source 1..1880: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3682 - RNA, 1847 nt, synthetic construct
  misc_feature 1..1847: note = mRNA product Design e-5 comprising derived and/or modified sequence from HRSV(A2)__F-del_DSCav1_mut3 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3683 - RNA, 1847 nt, synthetic construct
  misc_feature 1..1847: note = mRNA product Design e-5 comprising derived and/or modified sequence from HRSV(A2)__F-del_DSCav1_mut3 (opt1)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3684 - RNA, 1847 nt, synthetic construct
  misc_feature 1..1847: note = mRNA product Design e-5 comprising derived and/or modified sequence from HRSV(A2)__F-del_DSCav1_mut3 (opt2)
  source 1..1847: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3685 - RNA, 1847 nt, synthetic construct
  misc_feature 1..1847: note = mRNA product Design e-5 comprising derived and/or modified sequence from HRSV(A2)__F-del_DSCav1_mut3 (opt3)
  source 1..1847: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3686 - RNA, 1847 nt, synthetic construct
  misc_feature 1..1847: note = mRNA product Design e-5 comprising derived and/or modified sequence from HRSV(A2)__F-del_DSCav1_mut3 (opt4)
  source 1..1847: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3687 - RNA, 1847 nt, synthetic construct
  misc_feature 1..1847: note = mRNA product Design e-5 comprising derived and/or modified sequence from HRSV(A2)__F-del_DSCav1_mut3 (opt5)
  source 1..1847: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3688 - RNA, 1847 nt, synthetic construct
  misc_feature 1..1847: note = mRNA product Design e-5 comprising derived and/or modified sequence from HRSV(A2)__F-del_DSCav1_mut3 (opt6)
  source 1..1847: mol_type = other RNA
gggagagcggctcggccattttgtcccagtcagtccggaggctgcggctgcagaagtaccgcctgcggagtaactgcaaagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3689 - RNA, 1847 nt, synthetic construct
  misc_feature 1..1847: note = mRNA product Design e-5 comprising derived and/or modified sequence from HRSV(A2)__F-del_DSCav1_mut3 (opt11)
  source 1..1847: mol_type = other RNA
gggagagcggctcggccattttgtcccagtcagtccggaggctgcggctgcagaagtaccgcctgcggagtaactgcaaagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3690 - RNA, 1914 nt, synthetic construct
  misc_feature 1..1914: note = mRNA product Design e-6 comprising derived and/or modified sequence from HRSV(A2)__F-del_DSCav1_mut3 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3691 - RNA, 1914 nt, synthetic construct
  misc_feature 1..1914: note = mRNA product Design e-6 comprising derived and/or modified sequence from HRSV(A2)__F-del_DSCav1_mut3 (opt1)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3692 - RNA, 1914 nt, synthetic construct
  misc_feature 1..1914: note = mRNA product Design e-6 comprising derived and/or modified sequence from HRSV(A2)__F-del_DSCav1_mut3 (opt2)
  source 1..1914: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3693 - RNA, 1914 nt, synthetic construct
  misc_feature 1..1914: note = mRNA product Design e-6 comprising derived and/or modified sequence from HRSV(A2)__F-del_DSCav1_mut3 (opt3)
  source 1..1914: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3694 - RNA, 1914 nt, synthetic construct
  misc_feature 1..1914: note = mRNA product Design e-6 comprising derived and/or modified sequence from HRSV(A2)__F-del_DSCav1_mut3 (opt4)
  source 1..1914: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3695 - RNA, 1914 nt, synthetic construct
  misc_feature 1..1914: note = mRNA product Design e-6 comprising derived and/or modified sequence from HRSV(A2)__F-del_DSCav1_mut3 (opt5)
  source 1..1914: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3696 - RNA, 1914 nt, synthetic construct
  misc_feature 1..1914: note = mRNA product Design e-6 comprising derived and/or modified sequence from HRSV(A2)__F-del_DSCav1_mut3 (opt6)
  source 1..1914: mol_type = other RNA
gggagagcggctcggccattttgtcccagtcagtccggaggctgcggctgcagaagtaccgcctgcggagtaactgcaaagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3697 - RNA, 1914 nt, synthetic construct
  misc_feature 1..1914: note = mRNA product Design e-6 comprising derived and/or modified sequence from HRSV(A2)__F-del_DSCav1_mut3 (opt11)
  source 1..1914: mol_type = other RNA
gggagagcggctcggccattttgtcccagtcagtccggaggctgcggctgcagaagtaccgcctgcggagtaactgcaaagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3698 - RNA, 2130 nt, synthetic construct
  misc_feature 1..2130: note = mRNA product Design f-1 comprising derived and/or modified sequence from HRSV(A2)__F-del_DSCav1_mut3 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3699 - RNA, 2130 nt, synthetic construct
  misc_feature 1..2130: note = mRNA product Design f-1 comprising derived and/or modified sequence from HRSV(A2)__F-del_DSCav1_mut3 (opt1)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3700 - RNA, 2130 nt, synthetic construct
  misc_feature 1..2130: note = mRNA product Design f-1 comprising derived and/or modified sequence from HRSV(A2)__F-del_DSCav1_mut3 (opt2)
  source 1..2130: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3701 - RNA, 2130 nt, synthetic construct
  misc_feature 1..2130: note = mRNA product Design f-1 comprising derived and/or modified sequence from HRSV(A2)__F-del_DSCav1_mut3 (opt3)
  source 1..2130: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3702 - RNA, 2130 nt, synthetic construct
  misc_feature 1..2130: note = mRNA product Design f-1 comprising derived and/or modified sequence from HRSV(A2)__F-del_DSCav1_mut3 (opt4)
  source 1..2130: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3703 - RNA, 2130 nt, synthetic construct
  misc_feature 1..2130: note = mRNA product Design f-1 comprising derived and/or modified sequence from HRSV(A2)__F-del_DSCav1_mut3 (opt5)
  source 1..2130: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3704 - RNA, 2130 nt, synthetic construct
  misc_feature 1..2130: note = mRNA product Design f-1 comprising derived and/or modified sequence from HRSV(A2)__F-del_DSCav1_mut3 (opt6)
  source 1..2130: mol_type = other RNA
gggagagcggctcggccattttgtcccagtcagtccggaggctgcggctgcagaagtaccgcctgcggagtaactgcaaagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3705 - RNA, 2130 nt, synthetic construct
  misc_feature 1..2130: note = mRNA product Design f-1 comprising derived and/or modified sequence from HRSV(A2)__F-del_DSCav1_mut3 (opt11)
  source 1..2130: mol_type = other RNA
gggagagcggctcggccattttgtcccagtcagtccggaggctgcggctgcagaagtaccgcctgcggagtaactgcaaagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3706 - RNA, 1910 nt, synthetic construct
  misc_feature 1..1910: note = mRNA product Design f-2 comprising derived and/or modified sequence from HRSV(A2)__F-del_DSCav1_mut3 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3707 - RNA, 1910 nt, synthetic construct
  misc_feature 1..1910: note = mRNA product Design f-2 comprising derived and/or modified sequence from HRSV(A2)__F-del_DSCav1_mut3 (opt1)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3708 - RNA, 1910 nt, synthetic construct
  misc_feature 1..1910: note = mRNA product Design f-2 comprising derived and/or modified sequence from HRSV(A2)__F-del_DSCav1_mut3 (opt2)
  source 1..1910: mol_type = other RNA
gggagagcggctcggccattttgtcccagtcagtccggaggctgcggctgcagaagtaccgcctgcggagtaactgcaaagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3709 - RNA, 1910 nt, synthetic construct
  misc_feature 1..1910: note = mRNA product Design f-2 comprising derived and/or modified sequence from HRSV(A2)__F-del_DSCav1_mut3 (opt3)
  source 1..1910: mol_type = other RNA
gggagagcggctcggccattttgtcccagtcagtccggaggctgcggctgcagaagtaccgcctgcggagtaactgcaaagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3710 - RNA, 1910 nt, synthetic construct
  misc_feature 1..1910: note = mRNA product Design f-2 comprising derived and/or modified sequence from HRSV(A2)__F-del_DSCav1_mut3 (opt4)
  source 1..1910: mol_type = other RNA
gggagagcggctcggccattttgtcccagtcagtccggaggctgcggctgcagaagtaccgcctgcggagtaactgcaaagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3711 - RNA, 1910 nt, synthetic construct
  misc_feature 1..1910: note = mRNA product Design f-2 comprising derived and/or modified sequence from HRSV(A2)__F-del_DSCav1_mut3 (opt5)
  source 1..1910: mol_type = other RNA
gggagagcggctcggccattttgtcccagtcagtccggaggctgcggctgcagaagtaccgcctgcggagtaactgcaaagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3712 - RNA, 1910 nt, synthetic construct
  misc_feature 1..1910: note = mRNA product Design f-2 comprising derived and/or modified sequence from HRSV(A2)__F-del_DSCav1_mut3 (opt6)
  source 1..1910: mol_type = other RNA
gggagagcggctcggccattttgtcccagtcagtccggaggctgcggctgcagaagtaccgcctgcggagtaactgcaaagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3713 - RNA, 1910 nt, synthetic construct
  misc_feature 1..1910: note = mRNA product Design f-2 comprising derived and/or modified sequence from HRSV(A2)__F-del_DSCav1_mut3 (opt11)
  source 1..1910: mol_type = other RNA
gggagagcggctcggccattttgtcccagtcagtccggaggctgcggctgcagaagtaccgcctgcggagtaactgcaaagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3714 - RNA, 1901 nt, synthetic construct
  misc_feature 1..1901: note = mRNA product Design f-3 comprising derived and/or modified sequence from HRSV(A2)__F-del_DSCav1_mut3 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3715 - RNA, 1901 nt, synthetic construct
  misc_feature 1..1901: note = mRNA product Design f-3 comprising derived and/or modified sequence from HRSV(A2)__F-del_DSCav1_mut3 (opt1)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3716 - RNA, 1901 nt, synthetic construct
  misc_feature 1..1901: note = mRNA product Design f-3 comprising derived and/or modified sequence from HRSV(A2)__F-del_DSCav1_mut3 (opt2)
  source 1..1901: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3717 - RNA, 1901 nt, synthetic construct
  misc_feature 1..1901: note = mRNA product Design f-3 comprising derived and/or modified sequence from HRSV(A2)__F-del_DSCav1_mut3 (opt3)
  source 1..1901: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3718 - RNA, 1901 nt, synthetic construct
  misc_feature 1..1901: note = mRNA product Design f-3 comprising derived and/or modified sequence from HRSV(A2)__F-del_DSCav1_mut3 (opt4)
  source 1..1901: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3719 - RNA, 1901 nt, synthetic construct
  misc_feature 1..1901: note = mRNA product Design f-3 comprising derived and/or modified sequence from HRSV(A2)__F-del_DSCav1_mut3 (opt5)
  source 1..1901: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3720 - RNA, 1901 nt, synthetic construct
  misc_feature 1..1901: note = mRNA product Design f-3 comprising derived and/or modified sequence from HRSV(A2)__F-del_DSCav1_mut3 (opt6)
  source 1..1901: mol_type = other RNA
gggagagtcccgcagtcggcgtccagcggctctgcttgttcgtgtgtgtgtcgttgcaggccttattcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3721 - RNA, 1901 nt, synthetic construct
  misc_feature 1..1901: note = mRNA product Design f-3 comprising derived and/or modified sequence from HRSV(A2)__F-del_DSCav1_mut3 (opt11)
  source 1..1901: mol_type = other RNA
gggagagtcccgcagtcggcgtccagcggctctgcttgttcgtgtgtgtgtcgttgcaggccttattcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3722 - RNA, 2117 nt, synthetic construct
  misc_feature 1..2117: note = mRNA product Design f-4 comprising derived and/or modified sequence from HRSV(A2)__F-del_DSCav1_mut3 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3723 - RNA, 2117 nt, synthetic construct
  misc_feature 1..2117: note = mRNA product Design f-4 comprising derived and/or modified sequence from HRSV(A2)__F-del_DSCav1_mut3 (opt1)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3724 - RNA, 2117 nt, synthetic construct
  misc_feature 1..2117: note = mRNA product Design f-4 comprising derived and/or modified sequence from HRSV(A2)__F-del_DSCav1_mut3 (opt2)
  source 1..2117: mol_type = other RNA
gggagagtcccgcagtcggcgtccagcggctctgcttgttcgtgtgtgtgtcgttgcaggccttattcaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3725 - RNA, 2117 nt, synthetic construct
  misc_feature 1..2117: note = mRNA product Design f-4 comprising derived and/or modified sequence from HRSV(A2)__F-del_DSCav1_mut3 (opt3)
  source 1..2117: mol_type = other RNA
gggagagtcccgcagtcggcgtccagcggctctgcttgttcgtgtgtgtgtcgttgcaggccttattcaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3726 - RNA, 2117 nt, synthetic construct
  misc_feature 1..2117: note = mRNA product Design f-4 comprising derived and/or modified sequence from HRSV(A2)__F-del_DSCav1_mut3 (opt4)
  source 1..2117: mol_type = other RNA
gggagagtcccgcagtcggcgtccagcggctctgcttgttcgtgtgtgtgtcgttgcaggccttattcaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3727 - RNA, 2117 nt, synthetic construct
  misc_feature 1..2117: note = mRNA product Design f-4 comprising derived and/or modified sequence from HRSV(A2)__F-del_DSCav1_mut3 (opt5)
  source 1..2117: mol_type = other RNA
gggagagtcccgcagtcggcgtccagcggctctgcttgttcgtgtgtgtgtcgttgcaggccttattcaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3728 - RNA, 2117 nt, synthetic construct
  misc_feature 1..2117: note = mRNA product Design f-4 comprising derived and/or modified sequence from HRSV(A2)__F-del_DSCav1_mut3 (opt6)
  source 1..2117: mol_type = other RNA
gggagagtcccgcagtcggcgtccagcggctctgcttgttcgtgtgtgtgtcgttgcaggccttattcaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3729 - RNA, 2117 nt, synthetic construct
  misc_feature 1..2117: note = mRNA product Design f-4 comprising derived and/or modified sequence from HRSV(A2)__F-del_DSCav1_mut3 (opt11)
  source 1..2117: mol_type = other RNA
gggagagtcccgcagtcggcgtccagcggctctgcttgttcgtgtgtgtgtcgttgcaggccttattcaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3730 - RNA, 1893 nt, synthetic construct
  misc_feature 1..1893: note = mRNA product Design f-5 comprising derived and/or modified sequence from HRSV(A2)__F-del_DSCav1_mut3 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3731 - RNA, 1893 nt, synthetic construct
  misc_feature 1..1893: note = mRNA product Design f-5 comprising derived and/or modified sequence from HRSV(A2)__F-del_DSCav1_mut3 (opt1)
  source 1..1893: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3732 - RNA, 1893 nt, synthetic construct
  misc_feature 1..1893: note = mRNA product Design f-5 comprising derived and/or modified sequence from HRSV(A2)__F-del_DSCav1_mut3 (opt2)
  source 1..1893: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3733 - RNA, 1893 nt, synthetic construct
  misc_feature 1..1893: note = mRNA product Design f-5 comprising derived and/or modified sequence from HRSV(A2)__F-del_DSCav1_mut3 (opt3)
  source 1..1893: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3734 - RNA, 1893 nt, synthetic construct
  misc_feature 1..1893: note = mRNA product Design f-5 comprising derived and/or modified sequence from HRSV(A2)__F-del_DSCav1_mut3 (opt4)
  source 1..1893: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3735 - RNA, 1893 nt, synthetic construct
  misc_feature 1..1893: note = mRNA product Design f-5 comprising derived and/or modified sequence from HRSV(A2)__F-del_DSCav1_mut3 (opt5)
  source 1..1893: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3736 - RNA, 1893 nt, synthetic construct
  misc_feature 1..1893: note = mRNA product Design f-5 comprising derived and/or modified sequence from HRSV(A2)__F-del_DSCav1_mut3 (opt6)
  source 1..1893: mol_type = other RNA
gggagactttcccattctgtagcagaatttggtgttgcctgtggtcttggtcccgcggagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3737 - RNA, 1893 nt, synthetic construct
  misc_feature 1..1893: note = mRNA product Design f-5 comprising derived and/or modified sequence from HRSV(A2)__F-del_DSCav1_mut3 (opt11)
  source 1..1893: mol_type = other RNA
gggagactttcccattctgtagcagaatttggtgttgcctgtggtcttggtcccgcggagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3738 - RNA, 1889 nt, synthetic construct
  misc_feature 1..1889: note = mRNA product Design g-1 comprising derived and/or modified sequence from HRSV(A2)__F-del_DSCav1_mut3 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3739 - RNA, 1889 nt, synthetic construct
  misc_feature 1..1889: note = mRNA product Design g-1 comprising derived and/or modified sequence from HRSV(A2)__F-del_DSCav1_mut3 (opt1)
  source 1..1889: mol_type = other RNA
gggagactttcccattctgtagcagaatttggtgttgcctgtggtcttggtcccgcggagaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3740 - RNA, 1889 nt, synthetic construct
  misc_feature 1..1889: note = mRNA product Design g-1 comprising derived and/or modified sequence from HRSV(A2)__F-del_DSCav1_mut3 (opt2)
  source 1..1889: mol_type = other RNA
gggagactttcccattctgtagcagaatttggtgttgcctgtggtcttggtcccgcggagaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3741 - RNA, 1889 nt, synthetic construct
  misc_feature 1..1889: note = mRNA product Design g-1 comprising derived and/or modified sequence from HRSV(A2)__F-del_DSCav1_mut3 (opt3)
  source 1..1889: mol_type = other RNA
gggagactttcccattctgtagcagaatttggtgttgcctgtggtcttggtcccgcggagaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3742 - RNA, 1889 nt, synthetic construct
  misc_feature 1..1889: note = mRNA product Design g-1 comprising derived and/or modified sequence from HRSV(A2)__F-del_DSCav1_mut3 (opt4)
  source 1..1889: mol_type = other RNA
gggagactttcccattctgtagcagaatttggtgttgcctgtggtcttggtcccgcggagaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3743 - RNA, 1889 nt, synthetic construct
  misc_feature 1..1889: note = mRNA product Design g-1 comprising derived and/or modified sequence from HRSV(A2)__F-del_DSCav1_mut3 (opt5)
  source 1..1889: mol_type = other RNA
gggagactttcccattctgtagcagaatttggtgttgcctgtggtcttggtcccgcggagaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3744 - RNA, 1889 nt, synthetic construct
  misc_feature 1..1889: note = mRNA product Design g-1 comprising derived and/or modified sequence from HRSV(A2)__F-del_DSCav1_mut3 (opt6)
  source 1..1889: mol_type = other RNA
gggagactttcccattctgtagcagaatttggtgttgcctgtggtcttggtcccgcggagaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3745 - RNA, 1889 nt, synthetic construct
  misc_feature 1..1889: note = mRNA product Design g-1 comprising derived and/or modified sequence from HRSV(A2)__F-del_DSCav1_mut3 (opt11)
  source 1..1889: mol_type = other RNA
gggagactttcccattctgtagcagaatttggtgttgcctgtggtcttggtcccgcggagaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3746 - RNA, 1904 nt, synthetic construct
  misc_feature 1..1904: note = mRNA product Design g-2 comprising derived and/or modified sequence from HRSV(A2)__F-del_DSCav1_mut3 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3747 - RNA, 1904 nt, synthetic construct
  misc_feature 1..1904: note = mRNA product Design g-2 comprising derived and/or modified sequence from HRSV(A2)__F-del_DSCav1_mut3 (opt1)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3748 - RNA, 1904 nt, synthetic construct
  misc_feature 1..1904: note = mRNA product Design g-2 comprising derived and/or modified sequence from HRSV(A2)__F-del_DSCav1_mut3 (opt2)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3749 - RNA, 1904 nt, synthetic construct
  misc_feature 1..1904: note = mRNA product Design g-2 comprising derived and/or modified sequence from HRSV(A2)__F-del_DSCav1_mut3 (opt3)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3750 - RNA, 1904 nt, synthetic construct
  misc_feature 1..1904: note = mRNA product Design g-2 comprising derived and/or modified sequence from HRSV(A2)__F-del_DSCav1_mut3 (opt4)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3751 - RNA, 1904 nt, synthetic construct
  misc_feature 1..1904: note = mRNA product Design g-2 comprising derived and/or modified sequence from HRSV(A2)__F-del_DSCav1_mut3 (opt5)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3752 - RNA, 1904 nt, synthetic construct
  misc_feature 1..1904: note = mRNA product Design g-2 comprising derived and/or modified sequence from HRSV(A2)__F-del_DSCav1_mut3 (opt6)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3753 - RNA, 1904 nt, synthetic construct
  misc_feature 1..1904: note = mRNA product Design g-2 comprising derived and/or modified sequence from HRSV(A2)__F-del_DSCav1_mut3 (opt11)
  source 1..1904: mol_type = other RNA
gggagagtccgctcagccaggttgcagaagcggcttagcgtgtgtcctaatcttctctctgcgtgtaggtaggcctgtgccgcaaacaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3754 - RNA, 2136 nt, synthetic construct
  misc_feature 1..2136: note = mRNA product Design g-3 comprising derived and/or modified sequence from HRSV(A2)__F-del_DSCav1_mut3 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3755 - RNA, 2136 nt, synthetic construct
  misc_feature 1..2136: note = mRNA product Design g-3 comprising derived and/or modified sequence from HRSV(A2)__F-del_DSCav1_mut3 (opt1)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3756 - RNA, 2136 nt, synthetic construct
  misc_feature 1..2136: note = mRNA product Design g-3 comprising derived and/or modified sequence from HRSV(A2)__F-del_DSCav1_mut3 (opt2)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3757 - RNA, 2136 nt, synthetic construct
  misc_feature 1..2136: note = mRNA product Design g-3 comprising derived and/or modified sequence from HRSV(A2)__F-del_DSCav1_mut3 (opt3)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3758 - RNA, 2136 nt, synthetic construct
  misc_feature 1..2136: note = mRNA product Design g-3 comprising derived and/or modified sequence from HRSV(A2)__F-del_DSCav1_mut3 (opt4)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3759 - RNA, 2136 nt, synthetic construct
  misc_feature 1..2136: note = mRNA product Design g-3 comprising derived and/or modified sequence from HRSV(A2)__F-del_DSCav1_mut3 (opt5)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3760 - RNA, 2136 nt, synthetic construct
  misc_feature 1..2136: note = mRNA product Design g-3 comprising derived and/or modified sequence from HRSV(A2)__F-del_DSCav1_mut3 (opt6)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3761 - RNA, 2136 nt, synthetic construct
  misc_feature 1..2136: note = mRNA product Design g-3 comprising derived and/or modified sequence from HRSV(A2)__F-del_DSCav1_mut3 (opt11)
  source 1..2136: mol_type = other RNA
gggagagtccgctcagccaggttgcagaagcggcttagcgtgtgtcctaatcttctctctgcgtgtaggtaggcctgtgccgcaaacaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3762 - RNA, 1931 nt, synthetic construct
  misc_feature 1..1931: note = mRNA product Design g-4 comprising derived and/or modified sequence from HRSV(A2)__F-del_DSCav1_mut3 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3763 - RNA, 1931 nt, synthetic construct
  misc_feature 1..1931: note = mRNA product Design g-4 comprising derived and/or modified sequence from HRSV(A2)__F-del_DSCav1_mut3 (opt1)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3764 - RNA, 1931 nt, synthetic construct
  misc_feature 1..1931: note = mRNA product Design g-4 comprising derived and/or modified sequence from HRSV(A2)__F-del_DSCav1_mut3 (opt2)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3765 - RNA, 1931 nt, synthetic construct
  misc_feature 1..1931: note = mRNA product Design g-4 comprising derived and/or modified sequence from HRSV(A2)__F-del_DSCav1_mut3 (opt3)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3766 - RNA, 1931 nt, synthetic construct
  misc_feature 1..1931: note = mRNA product Design g-4 comprising derived and/or modified sequence from HRSV(A2)__F-del_DSCav1_mut3 (opt4)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3767 - RNA, 1931 nt, synthetic construct
  misc_feature 1..1931: note = mRNA product Design g-4 comprising derived and/or modified sequence from HRSV(A2)__F-del_DSCav1_mut3 (opt5)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3768 - RNA, 1931 nt, synthetic construct
  misc_feature 1..1931: note = mRNA product Design g-4 comprising derived and/or modified sequence from HRSV(A2)__F-del_DSCav1_mut3 (opt6)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3769 - RNA, 1931 nt, synthetic construct
  misc_feature 1..1931: note = mRNA product Design g-4 comprising derived and/or modified sequence from HRSV(A2)__F-del_DSCav1_mut3 (opt11)
  source 1..1931: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3770 - RNA, 1907 nt, synthetic construct
  misc_feature 1..1907: note = mRNA product Design g-5 comprising derived and/or modified sequence from HRSV(A2)__F-del_DSCav1_mut3 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3771 - RNA, 1907 nt, synthetic construct
  misc_feature 1..1907: note = mRNA product Design g-5 comprising derived and/or modified sequence from HRSV(A2)__F-del_DSCav1_mut3 (opt1)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3772 - RNA, 1907 nt, synthetic construct
  misc_feature 1..1907: note = mRNA product Design g-5 comprising derived and/or modified sequence from HRSV(A2)__F-del_DSCav1_mut3 (opt2)
  source 1..1907: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3773 - RNA, 1907 nt, synthetic construct
  misc_feature 1..1907: note = mRNA product Design g-5 comprising derived and/or modified sequence from HRSV(A2)__F-del_DSCav1_mut3 (opt3)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3774 - RNA, 1907 nt, synthetic construct
  misc_feature 1..1907: note = mRNA product Design g-5 comprising derived and/or modified sequence from HRSV(A2)__F-del_DSCav1_mut3 (opt4)
  source 1..1907: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3775 - RNA, 1907 nt, synthetic construct
  misc_feature 1..1907: note = mRNA product Design g-5 comprising derived and/or modified sequence from HRSV(A2)__F-del_DSCav1_mut3 (opt5)
  source 1..1907: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3776 - RNA, 1907 nt, synthetic construct
  misc_feature 1..1907: note = mRNA product Design g-5 comprising derived and/or modified sequence from HRSV(A2)__F-del_DSCav1_mut3 (opt6)
  source 1..1907: mol_type = other RNA
gggagacccgtgacccggaagttgtacggctacgcgactttccctcccacaaaccctcgcgcccttcctttcctacttgggcccggcagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3777 - RNA, 1907 nt, synthetic construct
  misc_feature 1..1907: note = mRNA product Design g-5 comprising derived and/or modified sequence from HRSV(A2)__F-del_DSCav1_mut3 (opt11)
  source 1..1907: mol_type = other RNA
gggagacccgtgacccggaagttgtacggctacgcgactttccctcccacaaaccctcgcgcccttcctttcctacttgggcccggcagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3778 - RNA, 1923 nt, synthetic construct
  misc_feature 1..1923: note = mRNA product Design h-1 comprising derived and/or modified sequence from HRSV(A2)__F-del_DSCav1_mut3 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3779 - RNA, 1923 nt, synthetic construct
  misc_feature 1..1923: note = mRNA product Design h-1 comprising derived and/or modified sequence from HRSV(A2)__F-del_DSCav1_mut3 (opt1)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3780 - RNA, 1923 nt, synthetic construct
  misc_feature 1..1923: note = mRNA product Design h-1 comprising derived and/or modified sequence from HRSV(A2)__F-del_DSCav1_mut3 (opt2)
  source 1..1923: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3781 - RNA, 1923 nt, synthetic construct
  misc_feature 1..1923: note = mRNA product Design h-1 comprising derived and/or modified sequence from HRSV(A2)__F-del_DSCav1_mut3 (opt3)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3782 - RNA, 1923 nt, synthetic construct
  misc_feature 1..1923: note = mRNA product Design h-1 comprising derived and/or modified sequence from HRSV(A2)__F-del_DSCav1_mut3 (opt4)
  source 1..1923: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3783 - RNA, 1923 nt, synthetic construct
  misc_feature 1..1923: note = mRNA product Design h-1 comprising derived and/or modified sequence from HRSV(A2)__F-del_DSCav1_mut3 (opt5)
  source 1..1923: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3784 - RNA, 1923 nt, synthetic construct
  misc_feature 1..1923: note = mRNA product Design h-1 comprising derived and/or modified sequence from HRSV(A2)__F-del_DSCav1_mut3 (opt6)
  source 1..1923: mol_type = other RNA
gggagacccgtgacccggaagttgtacggctacgcgactttccctcccacaaaccctcgcgcccttcctttcctacttgggcccggcagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3785 - RNA, 1923 nt, synthetic construct
  misc_feature 1..1923: note = mRNA product Design h-1 comprising derived and/or modified sequence from HRSV(A2)__F-del_DSCav1_mut3 (opt11)
  source 1..1923: mol_type = other RNA
gggagacccgtgacccggaagttgtacggctacgcgactttccctcccacaaaccctcgcgcccttcctttcctacttgggcccggcagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3786 - RNA, 2139 nt, synthetic construct
  misc_feature 1..2139: note = mRNA product Design h-2 comprising derived and/or modified sequence from HRSV(A2)__F-del_DSCav1_mut3 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3787 - RNA, 2139 nt, synthetic construct
  misc_feature 1..2139: note = mRNA product Design h-2 comprising derived and/or modified sequence from HRSV(A2)__F-del_DSCav1_mut3 (opt1)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3788 - RNA, 2139 nt, synthetic construct
  misc_feature 1..2139: note = mRNA product Design h-2 comprising derived and/or modified sequence from HRSV(A2)__F-del_DSCav1_mut3 (opt2)
  source 1..2139: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3789 - RNA, 2139 nt, synthetic construct
  misc_feature 1..2139: note = mRNA product Design h-2 comprising derived and/or modified sequence from HRSV(A2)__F-del_DSCav1_mut3 (opt3)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3790 - RNA, 2139 nt, synthetic construct
  misc_feature 1..2139: note = mRNA product Design h-2 comprising derived and/or modified sequence from HRSV(A2)__F-del_DSCav1_mut3 (opt4)
  source 1..2139: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3791 - RNA, 2139 nt, synthetic construct
  misc_feature 1..2139: note = mRNA product Design h-2 comprising derived and/or modified sequence from HRSV(A2)__F-del_DSCav1_mut3 (opt5)
  source 1..2139: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3792 - RNA, 2139 nt, synthetic construct
  misc_feature 1..2139: note = mRNA product Design h-2 comprising derived and/or modified sequence from HRSV(A2)__F-del_DSCav1_mut3 (opt6)
  source 1..2139: mol_type = other RNA
gggagacccgtgacccggaagttgtacggctacgcgactttccctcccacaaaccctcgcgcccttcctttcctacttgggcccggcagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3793 - RNA, 2139 nt, synthetic construct
  misc_feature 1..2139: note = mRNA product Design h-2 comprising derived and/or modified sequence from HRSV(A2)__F-del_DSCav1_mut3 (opt11)
  source 1..2139: mol_type = other RNA
gggagacccgtgacccggaagttgtacggctacgcgactttccctcccacaaaccctcgcgcccttcctttcctacttgggcccggcagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3794 - RNA, 1919 nt, synthetic construct
  misc_feature 1..1919: note = mRNA product Design h-3 comprising derived and/or modified sequence from HRSV(A2)__F-del_DSCav1_mut3 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3795 - RNA, 1919 nt, synthetic construct
  misc_feature 1..1919: note = mRNA product Design h-3 comprising derived and/or modified sequence from HRSV(A2)__F-del_DSCav1_mut3 (opt1)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3796 - RNA, 1919 nt, synthetic construct
  misc_feature 1..1919: note = mRNA product Design h-3 comprising derived and/or modified sequence from HRSV(A2)__F-del_DSCav1_mut3 (opt2)
  source 1..1919: mol_type = other RNA
gggagacccgtgacccggaagttgtacggctacgcgactttccctcccacaaaccctcgcgcccttcctttcctacttgggcccggcagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3797 - RNA, 1919 nt, synthetic construct
  misc_feature 1..1919: note = mRNA product Design h-3 comprising derived and/or modified sequence from HRSV(A2)__F-del_DSCav1_mut3 (opt3)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3798 - RNA, 1919 nt, synthetic construct
  misc_feature 1..1919: note = mRNA product Design h-3 comprising derived and/or modified sequence from HRSV(A2)__F-del_DSCav1_mut3 (opt4)
  source 1..1919: mol_type = other RNA
gggagacccgtgacccggaagttgtacggctacgcgactttccctcccacaaaccctcgcgcccttcctttcctacttgggcccggcagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3799 - RNA, 1919 nt, synthetic construct
  misc_feature 1..1919: note = mRNA product Design h-3 comprising derived and/or modified sequence from HRSV(A2)__F-del_DSCav1_mut3 (opt5)
  source 1..1919: mol_type = other RNA
gggagacccgtgacccggaagttgtacggctacgcgactttccctcccacaaaccctcgcgcccttcctttcctacttgggcccggcagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3800 - RNA, 1919 nt, synthetic construct
  misc_feature 1..1919: note = mRNA product Design h-3 comprising derived and/or modified sequence from HRSV(A2)__F-del_DSCav1_mut3 (opt6)
  source 1..1919: mol_type = other RNA
gggagacccgtgacccggaagttgtacggctacgcgactttccctcccacaaaccctcgcgcccttcctttcctacttgggcccggcagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3801 - RNA, 1919 nt, synthetic construct
  misc_feature 1..1919: note = mRNA product Design h-3 comprising derived and/or modified sequence from HRSV(A2)__F-del_DSCav1_mut3 (opt11)
  source 1..1919: mol_type = other RNA
gggagacccgtgacccggaagttgtacggctacgcgactttccctcccacaaaccctcgcgcccttcctttcctacttgggcccggcagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtggaagcattttcctggctgattaaaagaaattactcagctatggtcatctgttcctgttagaaggctatgcagcatattatatactatgcgcatgttatgaaatgcataataaaaaattttaaaaaatctaaaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3802 - RNA, 1982 nt, synthetic construct
  misc_feature 1..1982: note = mRNA product Design h-4 comprising derived and/or modified sequence from HRSV(A2)__F-del_DSCav1_mut3 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3803 - RNA, 1982 nt, synthetic construct
  misc_feature 1..1982: note = mRNA product Design h-4 comprising derived and/or modified sequence from HRSV(A2)__F-del_DSCav1_mut3 (opt1)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3804 - RNA, 1982 nt, synthetic construct
  misc_feature 1..1982: note = mRNA product Design h-4 comprising derived and/or modified sequence from HRSV(A2)__F-del_DSCav1_mut3 (opt2)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3805 - RNA, 1982 nt, synthetic construct
  misc_feature 1..1982: note = mRNA product Design h-4 comprising derived and/or modified sequence from HRSV(A2)__F-del_DSCav1_mut3 (opt3)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3806 - RNA, 1982 nt, synthetic construct
  misc_feature 1..1982: note = mRNA product Design h-4 comprising derived and/or modified sequence from HRSV(A2)__F-del_DSCav1_mut3 (opt4)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3807 - RNA, 1982 nt, synthetic construct
  misc_feature 1..1982: note = mRNA product Design h-4 comprising derived and/or modified sequence from HRSV(A2)__F-del_DSCav1_mut3 (opt5)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3808 - RNA, 1982 nt, synthetic construct
  misc_feature 1..1982: note = mRNA product Design h-4 comprising derived and/or modified sequence from HRSV(A2)__F-del_DSCav1_mut3 (opt6)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3809 - RNA, 1982 nt, synthetic construct
  misc_feature 1..1982: note = mRNA product Design h-4 comprising derived and/or modified sequence from HRSV(A2)__F-del_DSCav1_mut3 (opt11)
  source 1..1982: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3810 - RNA, 1998 nt, synthetic construct
  misc_feature 1..1998: note = mRNA product Design h-5 comprising derived and/or modified sequence from HRSV(A2)__F-del_DSCav1_mut3 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3811 - RNA, 1998 nt, synthetic construct
  misc_feature 1..1998: note = mRNA product Design h-5 comprising derived and/or modified sequence from HRSV(A2)__F-del_DSCav1_mut3 (opt1)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3812 - RNA, 1998 nt, synthetic construct
  misc_feature 1..1998: note = mRNA product Design h-5 comprising derived and/or modified sequence from HRSV(A2)__F-del_DSCav1_mut3 (opt2)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3813 - RNA, 1998 nt, synthetic construct
  misc_feature 1..1998: note = mRNA product Design h-5 comprising derived and/or modified sequence from HRSV(A2)__F-del_DSCav1_mut3 (opt3)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3814 - RNA, 1998 nt, synthetic construct
  misc_feature 1..1998: note = mRNA product Design h-5 comprising derived and/or modified sequence from HRSV(A2)__F-del_DSCav1_mut3 (opt4)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctgatcctgaaggccaacgccatcaccaccatcctgaccgccgtgaccttctgcttcgccagcggccagaacatcaccgaggagttctaccagagcacctgcagcgccgtgagcaagggctacctgggcgccctgagaaccggctggtacaccagcgtgatcaccatcgagctgagcaacatcaaggagatcaagtgcaacggcaccgacgccaaggtgaagctgatcaagcaggagctggacaagtacaagaacgccgtgaccgacctgcagctgctgatgcagagcacccccgccaccggcagcggcagcgccatctgcagcggcgtggccgtgtgcaaggtgctgcacctggagggcgaggtgaacaagatcaagagcgccctgctgagcaccaacaaggccgtggtgagcctgagcaacggcgtgagcgtgctgaccttcaaggtgctggacctgaagaactacatcgacaagcagctgctgcccatcctgaacaagcagagctgcagcatccccaacatcgagaccgtgatcgagttccagcagaagaacaacagactgctggagatcaccagagagttcagcgtgaacgccggcgtgaccacccccgtgagcacctacatgctgaccaacagcgagctgctgagcctgatcaacgacatgcccatcaccaacgaccagaagaagctgatgagcaacaacgtgcagatcgtgagacagcagagctacagcatcatgtgcatcatcaaggaggaggtgctggcctacgtggtgcagctgcccctgtacggcgtgatcgacaccccctgctggaagctgcacaccagccccctgtgcaccaccaacaccaaggagggcagcaacatctgcctgaccagaaccgacagaggctggtactgcgacaacgccggcagcgtgagcttcttcccccaggccgagacctgcaaggtgcagagcaacagagtgttctgcgacaccatgaacagcctgaccctgcccagcgaggtgaacctgtgcaacgtggacatcttcaaccccaagtacgactgcaagatcatgaccagcaagaccgacgtgagcagcagcgtgatcaccagcctgggcgccatcgtgagctgctacggcaagaccaagtgcaccgccagcaacaagaacagaggcatcatcaagaccttcagcaacggctgcgactacgtgagcaacaagggcgtggacaccgtgagcgtgggcaacaccctgtactgcgtgaacaagcaggagggccagagcctgtacgtgaagggcgagcccatcatcaacttctacgaccccctggtgttccccagcgacgagttcgacgccagcatcagccaggtgaacgagaagatcaaccagagcctggccttcatcagaaagagcgacgagctgctgcacaacgtgaacgccggcaagagcaccaccaacatcatgatcaccaccatcatcatcgtgatcatcgtgatcctgctgagcctgatcgccgtgggcctgctgctgtactgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3815 - RNA, 1998 nt, synthetic construct
  misc_feature 1..1998: note = mRNA product Design h-5 comprising derived and/or modified sequence from HRSV(A2)__F-del_DSCav1_mut3 (opt5)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgctattaccacaatccttacggccgtgaccttctgctttgcgagcggccagaatattacagaagagttctaccaatccacctgttctgctgtcagcaaagggtatctgggagccctcagaacaggctggtacacctccgttatcacaattgaactgtctaacatcaaggagatcaaatgcaatgggaccgacgccaaggtgaaacttattaagcaggaactggataagtataaaaacgctgtgacggacctccagctgctgatgcagagcacccccgccacaggatccggctctgctatctgtagcggggtcgccgtgtgcaaggttctccacctggagggagaggtgaataaaattaagtccgcgcttctgagcaccaacaaagccgtcgtgtctctctccaatggcgttagcgtgctgacatttaaggtccttgatctgaagaactacatcgacaaacaactcctgcctattctgaataagcagtcttgttccatcccgaacattgaaaccgtgatcgagttccagcagaaaaataaccggctcctggaaatcacgcgcgagtttagcgtgaatgctggcgtcacaacccccgtttctacatatatgcttaccaactccgagctgctcagcctgattaatgatatgcctatcaccaacgaccaaaagaaacttatgtccaacaatgtgcagattgtgagacagcagtcttacagcatcatgtgcattatcaaggaagaggtcctggcctatgtggttcaactccccctgtacggggtgatcgatacaccttgttggaaactgcatacgagccccctctgcaccacaaacaccaaggaaggatccaatatttgtctgacacggaccgaccgcggctggtactgcgataacgctgggtctgtctccttctttcctcaggccgagacgtgtaaggtgcagagcaatagagttttctgcgacacaatgaactctcttaccctgccgagcgaagtgaatctctgcaacgtcgatatctttaatcccaaatatgactgtaagattatgacctccaaaacagatgtgtctagctccgtcatcaccagcctgggagcgattgtgtcttgctacggcaagacaaaatgtacggcctccaacaagaatcgggggatcatcaagaccttcagcaacggatgcgactatgtttctaataaaggcgtggacacagtctccgtgggcaacaccctttactgtgttaataagcaagaggggcagagcctgtatgtgaaaggagagcctattatcaacttttacgatcccctcgtcttcccttccgacgaatttgatgcttctattagccaggtgaacgagaagatcaatcagtccctggccttcattcgcaaatctgacgaactgctccacaacgtgaatgctggcaagagcacaaccaacatcatgattacgaccatcatcattgttatcattgtcatcctgctttccctgattgccgtggggctcctgctgtattgcaaggccagatgaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3816 - RNA, 1998 nt, synthetic construct
  misc_feature 1..1998: note = mRNA product Design h-5 comprising derived and/or modified sequence from HRSV(A2)__F-del_DSCav1_mut3 (opt6)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaattactaatcctgaaagcaaacgcaattactacaatactaacagcagtaaccttttgctttgcctcaggacaaaacataactgaagaattttaccaatcaacttgctcagcagtctcaaaaggctatctaggagcactacgaacaggttggtatacttcagtcataacaatagaattatcaaacataaaagaaattaaatgtaacggaactgacgcaaaagtaaaactcatcaaacaagaactcgataaatacaaaaacgctgtaaccgacttacaactactaatgcaatcaactccagcaacaggctccggatccgcaatatgcagtggtgtagcagtatgcaaagtcctacacctagaaggagaagtaaataagataaaatctgctctactatcaacaaataaagcagttgtctccctatcaaatggagtctcagtactcaccttcaaagtattagacctcaaaaactacatagacaaacaactattaccaatactcaacaaacaatcctgctccatccctaacatagaaaccgtaatcgaatttcaacaaaaaaataacagactcttagaaataactagagaattttcagttaatgcaggcgtgacaacaccagtatcaacatatatgctaacaaactccgaactcctatccctaataaacgacatgccaatcacaaacgaccaaaaaaaactaatgtccaacaacgtacaaatcgtaagacaacaatcatactctataatgtgcataataaaagaagaagtactggcctacgtagtacaattaccactctacggagtaatagacaccccatgctggaaactccatacatcacccctatgcacaacaaacacaaaagaaggatccaacatatgtctcactagaacagacagaggctggtactgcgacaacgctggatccgtctcattcttcccccaagcagaaacatgtaaagtacaatctaatagagtattttgtgacacaatgaacagcctcacactaccatccgaagtcaacctatgtaacgtagatatatttaatcccaaatacgactgcaaaataatgacatccaaaacagatgtatcatcatccgttatcacctcactaggagccatagtttcatgctacggaaaaacaaaatgcactgcatctaacaaaaatagaggtataataaaaacattttccaacggctgcgactacgtctcaaacaaaggcgtagacaccgtatcagtaggaaatacattatattgcgtaaataaacaagaaggccaatccctatacgtaaaaggagaacccatcataaacttctatgacccacttgttttcccctcagacgaatttgacgcctcaatatcacaagtaaatgaaaaaataaaccaatctcttgccttcattagaaaatcagacgaattactacacaacgtcaacgcaggaaaatcaacaacaaacatcatgataacaacgataataatagtcataatagtaatactactatcattaatcgcagtcggactcctattatattgcaaagctagataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3817 - RNA, 1998 nt, synthetic construct
  misc_feature 1..1998: note = mRNA product Design h-5 comprising derived and/or modified sequence from HRSV(A2)__F-del_DSCav1_mut3 (opt11)
  source 1..1998: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggaactactcatactaaaagccaacgccataaccaccatcctcaccgcagtaactttctgcttcgcttccggccaaaacatcaccgaagaattttaccaaagtacctgcagcgcagtctcaaaaggatacctaggcgccctacgcacaggctggtacacctccgtcattaccatcgaactctccaacatcaaagaaattaaatgcaacggtacagacgcaaaagtcaaactcatcaaacaagaactcgacaaatacaaaaacgcagtcaccgacctccaactcctcatgcaatccacccccgccacaggctctggctccgccatctgctcaggcgtagcagtctgcaaagtcctgcacctcgaaggcgaagtcaacaaaatcaagtcagccctcctctccaccaacaaggccgtcgtatccctctcaaacggagttagcgtcctcaccttcaaagtcctagacctcaaaaactacatcgataaacaactactccccatcctaaacaaacaatcatgctccatcccaaacatcgaaaccgtaatcgagttccaacaaaagaacaaccgcctcctcgaaatcacacgtgagttctccgttaacgccggcgtcaccacccccgtctctacatacatgctcaccaactccgaactcctttccctcatcaacgacatgccaatcaccaacgaccaaaagaaactcatgtcaaacaacgtacaaatcgtccgacaacaaagctactccatcatgtgcatcatcaaagaagaagtccttgcatacgtcgttcaactacccctctacggcgtaatcgacactccctgctggaaactccacacctccccgctctgcacaaccaacaccaaagaaggcagcaacatctgcctcacccgaaccgaccgcggctggtactgcgataacgccggatccgtctccttcttcccacaagcagaaacttgcaaagtccaatccaaccgcgtcttctgcgacaccatgaactccctcacactcccctccgaagtcaacctgtgcaacgtcgacatcttcaacccaaaatacgactgcaaaatcatgacctcaaaaaccgacgtctcatcttctgtcatcacctctctcggcgctatcgtctcctgctatggcaaaaccaaatgcaccgcctccaacaagaaccgcggcattatcaagaccttctccaacggctgcgactacgtctccaataagggcgtcgacaccgtctctgtcggcaacaccctttactgcgtaaacaaacaagaaggtcaatctctctacgtcaaaggagaacccatcatcaacttctacgaccccctggtcttcccctccgacgagttcgatgcatcaatctcccaagtcaacgaaaagatcaaccaatctctcgctttcatccgcaaatccgacgaactcctacacaacgtaaacgccggcaaatccaccacaaacatcatgatcaccaccattatcatagtcatcatcgtcatcctcctctccttaatcgccgttggcctccttctctactgcaaagcccgataaggactagtactggctgcatctccctttcctctgtcctccatccttctcccaggatggtgaagggggacctggtacccagtgatccccaccccaggatcctaaatcatgacttacctgctaataaaaactcattggaaaagtgagaagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3818 - RNA, 1931 nt, synthetic construct
  misc_feature 1..1931: note = mRNA product Design i-1 comprising derived and/or modified sequence from HRSV(A2)__F-del_DSCav1_mut3 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcggaccggctggtacacctccgtgatcaccatcgagctgagcaacatcaaggagatcaagtgcaacgggaccgacgccaaggtgaagctcatcaagcaggagctggacaagtacaagaacgcggtcacggacctgcagctcctgatgcagtccaccccggcaaccggctccggctccgccatctgcagcggcgtcgccgtgtgcaaggtgctgcacctcgagggggaggtcaacaagatcaagagcgccctgctgtccaccaacaaggccgtggtgagcctctccaacggcgtcagcgtgctgaccttcaaggtgctggacctcaagaactacatcgacaagcagctgctgcccatcctgaacaagcagagctgctccatccccaacatcgagacggtgatcgagttccagcagaagaacaaccggctcctggagatcacccgcgagttcagcgtgaacgccggggtcaccacccccgtgtccacgtacatgctgaccaacagcgagctcctgtccctgatcaacgacatgccgatcaccaacgaccagaagaagctcatgagcaacaacgtgcagatcgtccggcagcagtcctacagcatcatgtgcatcatcaaggaggaggtgctggcgtacgtggtccagctgcccctctacggcgtgatcgacaccccctgctggaagctgcacacgagccccctgtgcaccaccaacaccaaggaggggtccaacatctgcctcacgcgcaccgaccggggctggtactgcgacaacgccggcagcgtctccttcttcccgcaggccgagacctgcaaggtgcagagcaaccgcgtgttctgcgacaccatgaactccctgacgctgcccagcgaggtaaacctctgcaacgtcgacatcttcaaccccaagtacgactgcaagatcatgacctccaagaccgacgtgagctccagcgtgatcacctccctgggggccatcgtcagctgctacggcaagacgaagtgcaccgccagcaacaagaaccgggggatcatcaagaccttctccaacggctgcgactacgtgagcaacaagggcgtggacaccgtgtccgtcgggaacaccctgtactgcgtgaacaagcaggagggccagagcctctacgtgaagggggagcccatcatcaacttctacgacccgctggtcttcccctccgacgagttcgacgcgagcatctcccaggtgaacgagaagatcaaccagagcctggccttcatccgcaagtccgacgagctgctccacaacgtgaacgccggcaagagcacgaccaacatcatgatcaccaccatcatcatcgtcatcatcgtgatcctgctgtccctcatcgccgtggggctgctgctctactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3819 - RNA, 1931 nt, synthetic construct
  misc_feature 1..1931: note = mRNA product Design i-1 comprising derived and/or modified sequence from HRSV(A2)__F-del_DSCav1_mut3 (opt1)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatcctgaaggccaacgccatcaccaccatcctgacggcggtgaccttctgcttcgccagcggccagaacatcaccgaggagttctaccagtccacgtgcagcgccgtctccaaggggtacctcggcgccctgcgcaccgggtggtacaccagcgtgatcaccatcgagctgtccaacatcaaggagatcaagtgcaacggcaccgacgccaaggtgaagctcatcaagcaggagctggacaagtacaagaacgcggtcacggacctgcagctcctgatgcagagcacccccgccaccgggtccggcagcgccatctgctccggcgtggccgtgtgcaaggtcctgcacctcgagggggaggtgaacaagatcaagagcgcgctgctgtccaccaacaaggccgtggtcagcctctccaacggcgtgagcgtgctgacgttcaaggtcctggacctcaagaactacatcgacaagcagctgctgccgatcctcaacaagcagtcctgcagcatccccaacatcgagaccgtgatcgagttccagcagaagaacaaccggctgctggagatcacccgcgagttctccgtgaacgccggggtcaccacgcccgtgagcacctacatgctcaccaactccgagctgctgagcctcatcaacgacatgcccatcaccaacgaccagaagaagctgatgagcaacaacgtgcagatcgtccggcagcagtcctacagcatcatgtgcatcatcaaggaggaggtgctggcctacgtggtccagctcccgctgtacggcgtgatcgacacgccctgctggaagctgcacaccagccccctctgcaccaccaacacgaaggaggggtccaacatctgcctgacccgcaccgaccggggctggtactgcgacaacgccggctccgtgagcttcttcccccaggcggagacctgcaaggtccagtccaaccgcgtgttctgcgacacgatgaacagcctgaccctcccgtccgaggtcaacctgtgcaacgtggacatcttcaaccccaagtacgactgcaagatcatgaccagcaagaccgacgtgtccagctccgtcatcacgagcctgggggccatcgtgtcctgctacggcaagaccaagtgcaccgccagcaacaagaaccgggggatcatcaagaccttctccaacggctgcgactacgtgagcaacaagggcgtcgacacggtgtccgtggggaacaccctctactgcgtcaacaagcaggagggccagagcctgtacgtgaagggggagcccatcatcaacttctacgaccccctggtgttcccgagcgacgagttcgacgcctccatcagccaggtcaacgagaagatcaaccagtccctcgccttcatccgcaagagcgacgagctgctgcacaacgtgaacgcgggcaagtccaccaccaacatcatgatcaccacgatcatcatcgtgatcatcgtcatcctcctgagcctgatcgccgtggggctcctgctgtactgcaaggcccggtgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3820 - RNA, 1931 nt, synthetic construct
  misc_feature 1..1931: note = mRNA product Design i-1 comprising derived and/or modified sequence from HRSV(A2)__F-del_DSCav1_mut3 (opt2)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctcctcatcctcaaggccaacgccatcaccaccatcctcaccgccgtcaccttctgcttcgcctccggccagaacatcaccgaggagttctaccagtccacctgctccgccgtctccaagggctacctcggcgccctccgcaccggctggtacacctccgtcatcaccatcgagctctccaacatcaaggagatcaagtgcaacggcaccgacgccaaggtcaagctcatcaagcaggagctcgacaagtacaagaacgccgtcaccgacctccagctcctcatgcagtccacccccgccaccggctccggctccgccatctgctccggcgtcgccgtctgcaaggtcctccacctcgagggcgaggtcaacaagatcaagtccgccctcctctccaccaacaaggccgtcgtctccctctccaacggcgtctccgtcctcaccttcaaggtcctcgacctcaagaactacatcgacaagcagctcctccccatcctcaacaagcagtcctgctccatccccaacatcgagaccgtcatcgagttccagcagaagaacaaccgcctcctcgagatcacccgcgagttctccgtcaacgccggcgtcaccacccccgtctccacctacatgctcaccaactccgagctcctctccctcatcaacgacatgcccatcaccaacgaccagaagaagctcatgtccaacaacgtccagatcgtccgccagcagtcctactccatcatgtgcatcatcaaggaggaggtcctcgcctacgtcgtccagctccccctctacggcgtcatcgacaccccctgctggaagctccacacctcccccctctgcaccaccaacaccaaggagggctccaacatctgcctcacccgcaccgaccgcggctggtactgcgacaacgccggctccgtctccttcttcccccaggccgagacctgcaaggtccagtccaaccgcgtcttctgcgacaccatgaactccctcaccctcccctccgaggtcaacctctgcaacgtcgacatcttcaaccccaagtacgactgcaagatcatgacctccaagaccgacgtctcctcctccgtcatcacctccctcggcgccatcgtctcctgctacggcaagaccaagtgcaccgcctccaacaagaaccgcggcatcatcaagaccttctccaacggctgcgactacgtctccaacaagggcgtcgacaccgtctccgtcggcaacaccctctactgcgtcaacaagcaggagggccagtccctctacgtcaagggcgagcccatcatcaacttctacgaccccctcgtcttcccctccgacgagttcgacgcctccatctcccaggtcaacgagaagatcaaccagtccctcgccttcatccgcaagtccgacgagctcctccacaacgtcaacgccggcaagtccaccaccaacatcatgatcaccaccatcatcatcgtcatcatcgtcatcctcctctccctcatcgccgtcggcctcctcctctactgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 3821 - RNA, 1931 nt, synthetic construct
  misc_feature 1..1931: note = mRNA product Design i-1 comprising derived and/or modified sequence from HRSV(A2)__F-del_DSCav1_mut3 (opt3)
  source 1..1931: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggagctgctcatccttaaggccaacgctattaccacaatactgactgcagtgacgttctgctttgccagcggccagaatatcaccgaagagttctaccaatccacatgttctgcggtctcaaaagggtatttgggagctttaagaactggttggtacaccagtgttattacaatcgaactgagcaacattaaggagatcaaatgcaatggcaccgacgccaaggtgaaactaataaagcaggaactcgataagtataaaaacgcagtaactgacctgcagcttctgatgcagtccacacccgccaccgggtctggatcggctatctgttcaggcgtggcagtctgcaaggtgttgcacctcgagggtgaggttaataaaattaagagcgccctgctgagtacgaacaaagctgtggtctccctctctaatggggtgagcgtattaacttttaaggttctggatcttaagaactacatcgacaaacaattgctgcctattctaaataagcagtcctgttcaatcccaaacatagaaaccgtgattgagttccagcagaaaaataacaggctcctggaaatcacacgggagtttagtgtcaatgccggagtgactaccccggtgagcacatatatgcttaccaactctgagctgttgtccctcattaatgatatgcccatcacgaacgaccaaaagaaactgatgtcaaacaatgtccagatcgttcgccagcagagctacagtattatgtgcataatcaaggaagaggtgttagcgtatgtagtgcaactgcctctctacggcgtcattgatactccatgttggaaacttcatacatctcccctgtgcaccactaacacaaaggaaggctccaatatctgtttgacccgaacggaccgtgggtggtactgcgataacgcaggaagcgtgtcgttctttcctcaggccgagacctgtaaggttcagtctaatagagtgttctgcgacacaatgaactccctaactctgccatcagaagtcaatctctgcaacgtggatatatttaatcccaaatatgactgtaagattatgaccagtaaaacagatgtaagctcctctgttatcactagcctgggtgctatcgtgtcatgctacggcaagaccaaatgtacagccagtaacaagaatagggggattatcaagaccttctccaacggatgcgactatgtcagcaataaaggcgtggacactgtctctgtgggtaacacgctttactgtgttaataagcaagaggggcagtcactgtatgtgaaaggagagcctattataaacttttacgatccattggtattcccgagtgacgaatttgatgcaagcatctcccaggtcaacgagaagattaatcagtctctcgctttcatccggaaatcggacgaactgttacacaacgtgaatgccggcaagagcacaaccaacatcatgattactaccataatcattgttatcattgtgatcctgctatccctcatagcggtcggcctgcttttgtattgcaaggcccgctgaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
